US011299723B2

(12) United States Patent
Liang et al.

(10) Patent No.: US 11,299,723 B2
(45) Date of Patent: Apr. 12, 2022

(54) ENGINEERED BETA-GLUCOSIDASES AND GLUCOSYLATION METHODS

(71) Applicant: Codexis, Inc., Redwood City, CA (US)

(72) Inventors: Jack Liang, San Mateo, CA (US); Jonathan Vroom, South San Francisco, CA (US); Stephanie Sue Galanie, Knoxville, TN (US); Nikki Dellas, Mountain View, CA (US); Ravi David Garcia, Los Gatos, CA (US)

(73) Assignee: Codexis, Inc., Redwood City, CA (US)

( * ) Notice: Subject to any disclaimer, the term of this patent is extended or adjusted under 35 U.S.C. 154(b) by 519 days.

(21) Appl. No.: 16/306,029

(22) PCT Filed: Jun. 9, 2017

(86) PCT No.: PCT/US2017/036704
§ 371 (c)(1),
(2) Date: Nov. 30, 2018

(87) PCT Pub. No.: WO2017/218325
PCT Pub. Date: Dec. 21, 2017

(65) Prior Publication Data
US 2019/0211318 A1 Jul. 11, 2019

Related U.S. Application Data

(60) Provisional application No. 62/350,625, filed on Jun. 15, 2016.

(51) Int. Cl.
*C12N 9/42* (2006.01)
*C12N 1/20* (2006.01)
(Continued)

(52) U.S. Cl.
CPC ............. *C12N 9/2445* (2013.01); *C12N 1/20* (2013.01); *C12N 9/1051* (2013.01); *C12N 15/70* (2013.01);
(Continued)

(58) Field of Classification Search
None
See application file for complete search history.

(56) References Cited

U.S. PATENT DOCUMENTS 4,356,196 A   10/1982   Hultquist
4,556,430 A   12/1985   Converse et al.
(Continued)

FOREIGN PATENT DOCUMENTS

EP   0641862 B1   12/2001
EP   2292773 A1   3/2011
(Continued)

OTHER PUBLICATIONS

Matsuzawa et al., "Crystal structure and identification of a key amino acid for glucose tolerance, substrate specificity, and transglycosylation activity of metagenomic beta-glucosidase Td2F2", The FEBS Journal, vol. 283, pp. 2340-2353, published Apr. 19, 2016 (Year: 2016).*

(Continued)

*Primary Examiner* — Richard C Ekstrom
(74) *Attorney, Agent, or Firm* — Codexis, Inc.

(57) ABSTRACT

The present invention provides engineered β-glucosidase (BGL) enzymes, polypeptides having BGL activity, and polynucleotides encoding these enzymes, as well as vectors and host cells comprising these polynucleotides and polypeptides. The present invention also provides compositions comprising the enzymes, and methods of using the engineered BGL enzymes to make products with β-glucose linkages.

32 Claims, 1 Drawing Sheet
Specification includes a Sequence Listing.

(51) Int. Cl.
  *C12N 15/52* (2006.01)
  *C12N 15/70* (2006.01)
  *C12P 19/14* (2006.01)
  *C12P 19/18* (2006.01)
  *C12N 9/10* (2006.01)

(52) U.S. Cl.
  CPC ............... *C12P 19/14* (2013.01); *C12P 19/18* (2013.01); *C12Y 302/01021* (2013.01); *C12Y 302/01169* (2013.01)

(56) References Cited

U.S. PATENT DOCUMENTS

| | | |
|---|---|---|
| 4,590,160 A | 5/1986 | Nishihashi et al. |
| 4,600,590 A | 7/1986 | Dale |
| 5,037,663 A | 8/1991 | Dale |
| 5,077,205 A | 12/1991 | Taniguchi et al. |
| 5,171,592 A | 12/1992 | Holtzapple et al. |
| 5,605,793 A | 2/1997 | Stemmer |
| 5,811,238 A | 9/1998 | Stemmer et al. |
| 5,830,721 A | 11/1998 | Stemmer et al. |
| 5,834,252 A | 11/1998 | Stemmer et al. |
| 5,837,458 A | 11/1998 | Minshull et al. |
| 5,928,905 A | 7/1999 | Stemmer et al. |
| 5,939,544 A | 8/1999 | Karstens et al. |
| 6,096,548 A | 8/2000 | Stemmer |
| 6,106,888 A | 8/2000 | Dale et al. |
| 6,117,679 A | 9/2000 | Stemmer |
| 6,132,970 A | 10/2000 | Stemmer |
| 6,165,793 A | 12/2000 | Stemmer |
| 6,176,176 B1 | 1/2001 | Dale et al. |
| 6,180,406 B1 | 1/2001 | Stemmer |
| 6,251,674 B1 | 6/2001 | Tobin et al. |
| 6,277,638 B1 | 8/2001 | Stemmer |
| 6,287,861 B1 | 9/2001 | Stemmer et al. |
| 6,287,862 B1 | 9/2001 | delCardayre et al. |
| 6,291,242 B1 | 9/2001 | Stemmer |
| 6,297,053 B1 | 10/2001 | Stemmer |
| 6,303,344 B1 | 10/2001 | Patten et al. |
| 6,309,883 B1 | 10/2001 | Minshull et al. |
| 6,319,713 B1 | 11/2001 | Patten et al. |
| 6,319,714 B1 | 11/2001 | Crameri et al. |
| 6,323,030 B1 | 11/2001 | Stemmer |
| 6,326,204 B1 | 12/2001 | delCardayre et al. |
| 6,335,160 B1 | 1/2002 | Patten et al. |
| 6,335,198 B1 | 1/2002 | delCardayre et al. |
| 6,344,356 B1 | 2/2002 | Stemmer |
| 6,352,859 B1 | 3/2002 | delCardayre et al. |
| 6,355,484 B1 | 3/2002 | Patten et al. |
| 6,358,740 B1 | 3/2002 | Patten et al. |
| 6,358,742 B1 | 3/2002 | Stemmer |
| 6,365,377 B1 | 4/2002 | Patten et al. |
| 6,365,408 B1 | 4/2002 | Stemmer |
| 6,368,861 B1 | 4/2002 | Crameri et al. |
| 6,372,497 B1 | 4/2002 | Stemmer |
| 6,376,246 B1 | 4/2002 | Crameri et al. |
| 6,379,964 B1 | 4/2002 | delCardayre et al. |
| 6,387,702 B1 | 5/2002 | Stemmer |
| 6,391,552 B2 | 5/2002 | Stemmer |
| 6,391,640 B1 | 5/2002 | Minshull et al. |
| 6,395,547 B1 | 5/2002 | Stemmer |
| 6,406,855 B1 | 6/2002 | Patten et al. |
| 6,406,910 B1 | 6/2002 | Patten et al. |
| 6,413,745 B1 | 7/2002 | Patten et al. |
| 6,413,774 B1 | 7/2002 | Stemmer |
| 6,420,175 B1 | 7/2002 | Stemmer |
| 6,423,542 B1 | 7/2002 | Crameri et al. |
| 6,426,224 B1 | 7/2002 | Crameri et al. |
| 6,436,675 B1 | 8/2002 | Welch et al. |
| 6,444,468 B1 | 9/2002 | Stemmer et al. |
| 6,455,253 B1 | 9/2002 | Patten et al. |
| 6,479,652 B1 | 11/2002 | Crameri et al. |
| 6,482,647 B1 | 11/2002 | Stemmer |
| 6,489,146 B2 | 12/2002 | Stemmer et al. |
| 6,506,602 B1 | 1/2003 | Stemmer |
| 6,506,603 B1 | 1/2003 | Stemmer |
| 6,519,065 B1 | 2/2003 | Colbourne et al. |
| 6,521,453 B1 | 2/2003 | Crameri et al. |
| 6,528,311 B1 | 3/2003 | delCardayre et al. |
| 6,537,746 B2 | 3/2003 | Arnold et al. |
| 6,573,098 B1 | 6/2003 | Stemmer |
| 6,576,467 B1 | 6/2003 | Stemmer |
| 6,579,678 B1 | 6/2003 | Patten et al. |
| 6,586,182 B1 | 7/2003 | Patten et al. |
| 6,602,986 B1 | 8/2003 | Stemmer et al. |
| 6,613,514 B2 | 9/2003 | Patten et al. |
| 6,653,072 B1 | 11/2003 | Patten et al. |
| 6,716,631 B1 | 4/2004 | delCardayre et al. |
| 6,946,296 B2 | 9/2005 | Patten et al. |
| 6,961,664 B2 | 11/2005 | Selfinov et al. |
| 6,995,017 B1 | 2/2006 | Stemmer |
| 7,024,312 B1 | 4/2006 | Selfinov et al. |
| 7,058,515 B1 | 6/2006 | Selfinov et al. |
| 7,105,297 B2 | 9/2006 | Minshull et al. |
| 7,148,054 B2 | 12/2006 | delCardayre et al. |
| 7,267,835 B2 | 9/2007 | Kitazume et al. |
| 7,288,375 B2 | 10/2007 | Stemmer et al. |
| 7,421,347 B2 | 9/2008 | Selfinov et al. |
| 7,430,477 B2 | 9/2008 | Selfinov et al. |
| 7,465,791 B1 | 12/2008 | Hallbert et al. |
| 7,534,564 B2 | 5/2009 | Patten et al. |
| 7,620,500 B2 | 11/2009 | Mundorff et al. |
| 7,620,502 B2 | 11/2009 | Selfinov et al. |
| 7,629,170 B2 | 12/2009 | delCardayre et al. |
| 7,702,464 B1 | 4/2010 | Emig et al. |
| 7,747,391 B2 | 6/2010 | Gustafsson et al. |
| 7,747,393 B2 | 6/2010 | Fox |
| 7,751,986 B2 | 7/2010 | Gustafsson et al. |
| 7,754,457 B2 | 7/2010 | Foody et al. |
| 7,776,598 B2 | 8/2010 | Patten et al. |
| 7,783,428 B2 | 8/2010 | Guslafsson et al. |
| 7,795,030 B2 | 9/2010 | Minshull et al. |
| 7,853,410 B2 | 12/2010 | Selfinov et al. |
| 7,868,138 B2 | 1/2011 | Stemmer et al. |
| 7,873,499 B2 | 1/2011 | Selfinov et al. |
| 7,904,249 B2 | 3/2011 | Selfinov et al. |
| 7,957,912 B2 | 6/2011 | Selfinov et al. |
| 8,383,346 B2 | 2/2013 | Colbeck et al. |
| 8,504,498 B2 | 8/2013 | Fox |
| 8,762,066 B2 | 6/2014 | Fox |
| 8,768,871 B2 | 7/2014 | Fox |
| 8,849,575 B2 | 9/2014 | Gustafsson et al. |
| 9,243,273 B2 | 1/2016 | Markosyan et al. |
| 9,387,797 B2 | 7/2016 | Dippold et al. |
| 9,562,251 B2 | 2/2017 | Kishore et al. |
| 9,957,540 B2 | 5/2018 | Mikkelsen et al. |
| 10,378,000 B2 * | 8/2019 | Gladden ............... C12N 9/2445 |
| 2006/0073161 A1 | 4/2006 | Breton |
| 2006/0195947 A1 | 8/2006 | Davis et al. |
| 2007/0031953 A1 | 12/2007 | Dunson et al. |
| 2008/0104724 A1 | 5/2008 | Sticklen et al. |
| 2008/0220990 A1 | 9/2008 | Fox |
| 2009/0181854 A1 | 7/2009 | Thorson et al. |
| 2009/0312196 A1 | 12/2009 | Colbeck et al. |
| 2013/0004979 A1 | 1/2013 | Thorson et al. |
| 2013/0123115 A1 | 5/2013 | Kettling et al. |
| 2013/0171328 A1 | 7/2013 | Kishore et al. |
| 2014/0256018 A1 | 9/2014 | Zhang et al. |
| 2014/0357588 A1 | 12/2014 | Markosyan et al. |
| 2015/0011660 A1 | 1/2015 | Markosyan |
| 2015/0031868 A1 | 1/2015 | Lehmann et al. |
| 2015/0159188 A1 | 6/2015 | Ono et al. |
| 2015/0218533 A1 | 8/2015 | Ono |
| 2015/0237898 A1 | 8/2015 | Carlson et al. |
| 2015/0361476 A1 | 12/2015 | Simon et al. |
| 2016/0010133 A1 | 1/2016 | Park et al. |
| 2016/0039856 A1 | 2/2016 | Prakash et al. |
| 2016/0083767 A1 | 3/2016 | Kim et al. |
| 2016/0097070 A1 | 4/2016 | Mao et al. |
| 2016/0186225 A1 | 6/2016 | Mikkelsen et al. |
| 2016/0198748 A1 | 7/2016 | Prakash et al. |
| 2016/0251635 A1 | 9/2016 | Mao et al. |

(56) References Cited

U.S. PATENT DOCUMENTS

| | | | |
|---|---|---|---|
| 2016/0298159 A1 | 10/2016 | Tao et al. | |
| 2017/0211113 A1 | 7/2017 | Tao et al. | |
| 2019/0211318 A1* | 7/2019 | Liang | C12N 9/1051 |

FOREIGN PATENT DOCUMENTS

| | | |
|---|---|---|
| WO | 95/22625 A1 | 8/1995 |
| WO | 95/33836 A1 | 12/1995 |
| WO | 96/00787 A1 | 1/1996 |
| WO | 97/0078 A1 | 1/1997 |
| WO | 97/35966 A1 | 10/1997 |
| WO | 98/27230 A1 | 6/1998 |
| WO | 2000/42651 A1 | 7/2000 |
| WO | 2001/75767 A2 | 10/2001 |
| WO | 2009/008908 A2 | 1/2009 |
| WO | 2009/045651 A2 | 4/2009 |
| WO | 2009/102899 A1 | 8/2009 |
| WO | 2009/102901 A1 | 8/2009 |
| WO | 2009/152336 A1 | 12/2009 |
| WO | 2010/022511 A1 | 3/2010 |
| WO | 2011/035105 A1 | 3/2011 |
| WO | 2013/003290 A1 | 1/2013 |
| WO | 2013/138339 A1 | 9/2013 |
| WO | 2013/176738 A1 | 11/2013 |
| WO | 2014/120819 A1 | 8/2014 |
| WO | 2014/120821 A1 | 8/2014 |
| WO | 2015/017254 A1 | 2/2015 |
| WO | 2015/048573 A1 | 4/2015 |
| WO | 2016/028899 A1 | 2/2016 |
| WO | 2016/043926 A1 | 3/2016 |
| WO | 2016/055578 A1 | 4/2016 |
| WO | 2016/073740 A1 | 5/2016 |
| WO | 2016/085919 A1 | 6/2016 |
| WO | 2016/146711 A1 | 9/2016 |
| WO | 2016/151046 A1 | 9/2016 |

OTHER PUBLICATIONS

Altschul, S., et al., "Basic local alignment search tool," J. Mol. Biol., 215: 403-410 [1990].

Altschul, S.F., et al., "Gapped BLAST and PSI-BLAST: a new generation of protein database search programs," Nucleic Acids Res., 25(17):3389-3402 [1997].

Baldino, Jr., F., et al., "High-Resolution in Situ Hybridization Histochemistry," Methods Enzymology, 168:761-777 (1989).

Batzer, M.A., "Erratum: Structure and variability of recently inserted Alu family members", Nucleic Acids Res 19:698-699 [1991].

Beaucage, S.L., et al., "Deoxynucleoside phosphoamidites—A new class of key intermediates for deoxypolynucleotide synthesis," Tetrahedron Letters, 22(20):1859-62 (1981).

Black, M.E., et al., "Creation of drug-specific herpes simplex virus type 1 thymidine kinase mutants for gene therapy," Proc Natl Acad Sci USA, 93:3525-3529 (1996).

Bohlin, C., et al., "A comparative study of hydrolysis and transglycosylation activities of fungal β-glucosidases," Appl. Microbiol. Biotechnol., 97(1): 159-169 [2012].

Bolton, E.T., et al., "A General Method for the lisolation of RNA Complementary to DNA," Proc. Natl. Acad. Sci. USA 48:1390 (1962).

Botstein, D., et al., "Strategies and applications of in vitro mutagenesis," Science, 229(4719):1193-1201 [1985].

Breslauer, K.J., et al., "Predicting DNA duplex stability from the base sequence," Proc. Natl. Acad. Sci. USA, 83:3746-3750 (1986).

Caldwell, R.C., et al., "Mutagenic PCR," PCR Methods Appl., 3:S136-S140 [1994].

Carter, P., "Site-directed mutagenesis," Biochem. J., 237:1-7 [1986].

Christians, F.C., et al., "Directed evolution of thymidine kinase for AZT phosphorylation using DNA family shuffling," Nat. Biotechnol., 17:259-264 (1999).

Crameri, A., et al., "DNA shuffling of a family of genes from diverse species accelerates directed evolution", Nature, 391:288-291 (1998).

Crameri, A., et al., "Improved green fluorescent protein by molecular evolution using DNA shuffling," Nat. Biotechnol., 14(3):315-319 (1996).

Crameri, A., et al., "Molecular evolution of an arsenate detoxification pathway by DNA shuffling," Nat. Biotechnol., 15(5):436-438 (1997).

Dale, S.J., et al., "Oligonucleotide-directed random mutagenesis using the phosphorothioate method," Methods Mol. Biol., 57:369-74 (1996).

De Boer, H.A., et al., "The tac promoter: A functional hybrid derived from the trp and lac promoters," Proc. Natl Acad. Sci. USA, 80: 21-25 (1983).

Freier, S.M., et al., "Improved free-energy parameters for predictions of RNA duplex stability," Proc. Natl. Acad. Sci USA, 83:9373-9377 (1986).

Guo, Z., et al., "3'-End-Forming Signals of Yeast mRNA," Mol. Cell. Biol., 15(11):5983-5990 [1995].

Henaut and Danchin in Neidhardt et al. [eds.], *Escherichia coli* and *Salmonella*,"Analysis and predictions from *Escherichia coli* Sequences, or *E. coli* in silico," ASM Press, Washington D.C., [1987], pp. 2047-2066.

Henikoff, S., et al., "Amino acid substitution matrices from protein blocks," Proc. Natl. Acad. Sci., 89:10915-10919 (1992).

Kierzek, R., et al., "Polymer-Supported RNA Synthesis and Its Application To Test the Nearest-Neighbor Model for Duplex Stability," Biochemistry, 25:7840-7846 (1986).

Koszelewski, D., et al., "Immobilization of omega-transaminases by encapsulation in a sol-gel/celite matrix," J. Mol. Cat. B: Enz., 63: 39-44 [2010].

Kramer, B., et al., "Different base/base mismatches are corrected with different efficiencies by the methyl-directed DNA mismatch-repair system of *E. coli*," Cell, 38(3):879-887, 1984.

Ling, M., et al., "Approaches to DNA Mutagenesis:An Overview," Anal. Biochem., 254:157-78 (1997).

Martin, A.R., et al. "Characterization of free and immobilized (S)-aminotransferase for acetophenone production," Appl. Microbiol. Biotechnol., 76: 843-851 [2007].

Mateo, C., et al., "Epoxy Sepabeads: A Novel Epoxy Support for Stabilization of Industrial Enzymes via Very Intense Multipoint Covalent Attachment," Biotechnol. Prog., 18:629-34 [2002].

Matthes, H.W.D., et al., "Simultaneous rapid chemical synthesis of over one hundred oligonucleotides on a microscale," EMBO J., 3(4):801-05 (1984).

McInerney, J.O., "GCUA: general codon usage analysis," Bioinformatics, 14(4):372-73 [1998].

Minshull, J., et al., "Protein evolution by molecular breeding," Curr. Op. Chem. Biol., 3(3):284-290 (1999).

Nakamura, Y., et al., "Codon usage tabulated from international DNA sequence databases: status for the year 2000," Nucl. Acids Res., 28:292 [2000].

Needleman, S., et al., "A general method applicable to the search for similarities in the amino acid sequence of two proteins," J. Mol. Biol. 48:443-453 (1970).

Pearson, W.R., "Improved tools for biological sequence comparison," Proc. Nat'l. Acad. Sci. USA, 85:2444-2448 (1988).

Romanos, M.A., et al., "Foreign gene expression in yeast: a review," Yeast 8:423-488 [1992].

Rychlik, W., et al., "Optimization of the annealing temperature for DNA amplification in vitro," Nucleic Acids Res, 18(21):6409-6412 (1990).

Simonen, M., et al., "Protein Secretion in *Bacillus* Species," Microbiological Reviews, 57:109-137 (1993).

Smith, M., "In vitro mutagenesis," Ann. Rev. Genet., 19:423-462 (1985).

Smith, T., et al., "Comparison of Biosequences," Adv. Appl. Math, 2:482-489 (1981).

Stellwagon, E., "Dye Affinity Chromatography," Current Protocols in Protein Science, Unit 9.2-9.2.16 [2001].

Stemmer, W., "DNA Shuffling by Random Fragmentation and Reassembly: In vitro Recombination for Molecular Evolution," Proc. Natl. Acad. Sci. USA, 91:10747-10751 (1994).

Stemmer, W.P.C., "Rapid evolution of a protein in vitro by DNA shuffling", Nature, 370:389-391 (1994).

(56) References Cited

OTHER PUBLICATIONS

Stenico, M., et al., "Codon usage in Caenorhabditis elegans: delineation of translational selection and mutational biases," Nucl. Acids Res. 22(13):2437-46 [1994].
Suggs, S.V., et al., "Use of synthetic oligodeoxyribonucleotides for the isolation of specific cloned DNA sequenes," In Developmental Biology Using Purified Genes (Brown et al., eds.), pp. 683-693, Academic Press (1981).
Tiwari, S., et al., "Prediction of probable genes by Fourier analysis of genomic sequences," Comput. Appl. Biosci. 13(3):263-270 [1997].
Truppo, M.D., et al., "Development of an Improved Immobilized CAL-B for the Enzymatic Resolution of a Key Intermediate to Odanacatib," Org. Proc. Res. Develop., 15:1033-1035 [2011].
Uberbacher, E.C., et al., "Discovering and Understanding Genes in Human DNA Sequence Using GRAIL," Methods Enzymol., 266:259-281 [1996].
Uchiyama, T., et al., "Characterization of a Novel β-Glucosidase from a Compost Microbial Metagenome with Strong Transglycosylation Activity," J. Biol. Chem. 288:18325-334 [2013].
Villa-Komaroff, L., et al., "A bacterial clone synthesizing proinsulin," Proc. Natl Acad. Sci. USA, 75:3727-3731 (1978).
Wada, K., et al., "Codon usage tabulated from the GenBank genetic sequence data," Nucl. Acids Res., 20:2111-2118 [1992].
Geneseq Accession No. AEX29253 dated May 3, 2007.
UniProt Accession No. T1WFB6 dated Nov. 13, 2013.
Tao, Y.-L. et al., "Cloning, expression, and characterization of the β-glucosidase hydrolyzing secoisolariciresinol diglucoside to secoisolariciresinol from Bacteroides uniformis ZL1," Applied Microbiology and Biotechnology, 98:2519-2531 [2014].
Singla, R., et al., "Synthesis of rebaudioside A from stevioside and their interaction model with hTAS2R4 bitter taste receptor," Phytochemistry, 125:106-111 [2016].
Matsuzawa, T., et al., "Crystal Structure and identification of a key amino acid for glucose tolerance, substrate specificity, and transglycosylation activity of metagenomic beta-glucosidase Td2F2," FEBS Journal, 283 (12):2340-2353 [2016].
Uchiyama, T., et al, "Characterization of a Novel Beta-Glucosidase from a Compost Microbial Metagenome with Strong Transglycosylation Activity," Journal of Biological Chemistry, 288(25):18325-183347 [2013].
Weil, J., et al., "Pretreatment of Yellow Poplar Sawdustby Pressure Cooking in Water," Appl. Biochem. Biotechnol., 68(1-2): 21-40 [1997].
Wells, J.A., et al., "Cassette mutagenesis: an efficient method for generation of multiple mutations at defined sites," Gene, 34:315-323 (1985).
Wetmur, J. G., "DNA Probes: Applications of the Principles of Nucleic Acid Hybridization," Crit Rev Biochem Mol Biol, 26(3/4):227-259 (1991).
Wright, F., "The 'effective number of codons' used in a gene," Gene 87:23-29 [1990].
Yaegaki, K., et al., "Improved high-performance liquid chromatography method for quantitation of proline and hydroxyproline in biological materials," J Chromatogr., 356(1):163-70 [1986].
Yi, S., et al., "Covalent immobilization of w-transaminase from Vibrio fluvialis JS17 on chitosan beads," Proc. Biochem., 42: 895-898 [2007].
Yoneda, A., et al., "Glycosylation variants of a β-glucosidase secreted by a Taiwanese fungus, *Chaetomella raphigera*, exhibit variant-specific catalytic and biochemical properties," Plos One, 9(9):1-12 [2014].
Zhang, J-H., et al., "Directed evolution of a fucosidase from a galactosidase by DNA shuffling and screening ," Proc. Nat. Acad. Sci., U.S.A., 94:4504-4509 (1997).
Zhao, H., et al., "Molecular evolution by staggered extension process (StEP) in vitro recombination," Nat. Biotechnol., 16:258-261 (1998).
Office Action from Japanese Patent Application No. 2018-565298 dated Apr. 23, 2021.

* cited by examiner

US 11,299,723 B2

ENGINEERED BETA-GLUCOSIDASES AND GLUCOSYLATION METHODS

The present application is a national stage application filed under 35 USC § 371 and claims priority to international application to PCT International Application No. PCT/US2017/036704, filed Jun. 9, 2017, which claims priority to U.S. Prov. Pat. Appln. Ser. No. 62/350,625, filed Jun. 15, 2016, which is hereby incorporated by reference in its entirety for all purposes.

FIELD OF THE INVENTION

The present invention provides engineered β-glucosidase (BGL) enzymes, polypeptides having BGL activity, and polynucleotides encoding these enzymes, as well as vectors and host cells comprising these polynucleotides and polypeptides. The present invention also provides compositions comprising the enzymes, and methods of using the engineered BGL enzymes to make products with β-glucose linkages.

REFERENCE TO A "SEQUENCE LISTING," A TABLE, OR A COMPUTER PROGRAM LISTING APPENDIX SUBMITTED AS AN ASCII TEXT FILE

The official copy of the Sequence Listing is submitted concurrently with the specification as an ASCII formatted text file via EFS-Web, with a file name of "CX8-157USP1_ST25.txt", a creation date of Jun. 15, 2016, and a size of 1,110,016 bytes. The Sequence Listing filed via EFS-Web is part of the specification and is incorporated in its entirety by reference herein.

BACKGROUND OF THE INVENTION

Glycoside hydrolases (glycosidases, glycosyl hydrolases) function in the hydrolysis of glycosidic bonds in complex sugars. They are common enzymes with various roles in nature. They typically are named based on their substrates. β-glucosidases (BGL) (EC 3.2.1.21; β-D-glucoside glucohydrolase) play a number of different and important roles in biology, including the degradation of cellulosic biomass by fungi and bacteria, degradation of glycolipids in mammalian lysosomes, and the cleavage of glucosylated flavonoids in plants.

Glycosidases have been assigned to families based on sequence similarities. Currently, there are 135 families listed in the CAZy (CAhohydrate-Active EnZyme) site. With few exceptions, all simple β-glucosidases belong to either Family 1 or Family 3. Family 1 contains bacterial, plant and mammalian enzymes (e.g., 6-phospho-glucosidases). Most Family 1 enzymes also have significant galactosidase activity. Family 3 contains fungal, bacterial and plant β-glucosidases and hexosaminidases. Enzymes in both families hydrolyze their substrates with net retention of anomeric configuration, via a two-step, double-displacement mechanisms involving two key active site carboxylic acid residues. In the first step, one of the carboxylic acids (i.e., the nucleophile) attacks at the substrate anomeric center, while the other (i.e., the acid/base catalyst), protonates the glycosidic oxygen, thereby facilitating the departure of the aglycone. This results in the formation of a covalent α-glycosyl-enzyme intermediate. In the second step, this intermediate is hydrolyzed by general base-catalyzed attack of water at the anomeric center of the glycosyl-enzyme, to release the β-glucose product and regenerate the enzyme. Both the formation and hydrolysis of this intermediate proceed via transition states with substantial oxocarbenium ion character.

Transglycosylation is another important reaction in biology. In this reaction, a sugar residue is transferred from one glycoside to another. It is a mechanism for glycosidic bond formation, particularly during the synthesis of polysaccharides. Nucleoside phosphate derivatives typically serve as activated donor compounds, in which the energies of their glycosidic bonds are partially conserved in the reaction products. Transglycosylation eliminates the need for nucleoside phosphate sugars by transferring glycosyl residues directly between a substrate and donor.

SUMMARY OF THE INVENTION

The present invention provides engineered β-glucosidase (BGL) enzymes, polypeptides having BGL activity, and polynucleotides encoding these enzymes, as well as vectors and host cells comprising these polynucleotides and polypeptides. The present invention also provides compositions comprising the enzymes, and methods of using the engineered. BGL enzymes to make products with β-glucose linkages.

The present invention provides non-naturally occurring beta-glucosidase variants having at least 80% sequence identity to SEQ ID NO:12, 14, 16, 18, and/or 20. In some embodiments, the non-naturally occurring beta-glucosidase variant comprises at least one substitution at one or more positions selected from 31, 32, 34, 36, 37, 38, 57/91, 58, 59, 60, 61, 62, 62/403, 66, 70, 89, 89/187, 91/595, 124/297, 125, 126/188, 133, 138/296, 147, 150, 184, 186, 187, 230, 231, 233, 266, 296, 297, 403, 405, 449, 450, 492, 590, and 601, wherein the positions are numbered with reference to SEQ ID NO:12. In some further embodiments, the non-naturally occurring beta-glucosidase variant comprises at least one substitution selected from 31C/G, V32G/P/S, 34I/P, 36P, 37K/W, 38E, 57R/91P, 58P, 59R, 60C/R/V, 61R, 62N, 62P/403R, 66G/N, 70W, 89L, 89S/187R, 91G/595V, 124D/297P, 125G, 126V/188R, 133G/R, 138G/296S, 147L, 150H/L/M/P/T, 184A/R, 186E, 187G/N/Y, 230F/H/I, 231G/R 233L/P/Q, 266F/G, 296R/T, 297R, 403E/P, 405R, 449G/P, 450G, 492P, 590W, 601A/E/L, 601E, and 601L, wherein the positions are numbered with reference to SEQ ID NO:12. In some additional embodiments, the non-naturally occurring beta-glucosidase variant comprises at least one substitution selected from P31C/G, V32G/P/S, G34/IP, I36P, T37K/W, T38E, G57R/I91P), L58P, F59R, N60C/R/V, L61R, K62N, K62P/W403R, R66G/N, V70W, D89L, D89S/H187R, I91G/G595V, A124D/V297P, S125G, A126V/F188R, F133G/R, D138G/M296S, R147L, E150H/L/M/P/T, C184A/R, K186E, H187G/N/Y, M230F/H/I, A231G/R, F233L/P/Q, Y266F/G, M296R/T, V297R, W403E/P V405R, M449G/P, F450G, S492P, R590W, and F601A/E/L, wherein the positions are numbered with reference to SEQ ID NO:12. In yet some additional embodiments, the non-naturally occurring beta-glucosidase variant comprises at least one substitution at one or more positions selected from 32, 34, 36, 57/91, 58, 59, 60, 62, 62/403, 66, 89, 89/187, 91/595, 124/297, 126/188, 133, 138/296, 147, 150, 184, 186, 187, 230, 231, 233, 266, 296, 297, 403, 405, 449, 492, 590, and 601, wherein the positions are numbered with reference to SEQ ID NO:12. In some further embodiments, the non-naturally occurring beta-glucosidase variant comprises at least one substitution selected from 32G/P/S, 34I/P, 36P, 57R/91P, 58P, 59R, 60C/R/V, 62N, 62P/403R, 66N, 89L, 89S/187R, 91G/595V, 124D/297P, 126V/188R, 133G/R, 138G/, 296S, 147L, 150H/M/P/T, 184R, 186E, 187G, 187N/Y, 230F/H/I, 231G/R, 233P/Q, 266F/G, 296R/T, 297R, 403E/P, 405R, M449G/P, 492P, 590W, and 601A/E/L, wherein the positions are numbered with reference to SEQ ID NO:12. In some additional embodiments, the non-naturally occurring beta-glucosidase variant comprises at least one substitution selected from V32G/P/S, G34I/P, I36P, G57R/I91P, L58P, F59R, N60C/R/V, K62N, K62P/W403R, R66N, D89L, D89S/H187R, I91G/G595V, A124D/V297P, A126V/F188R, F133G/R, D138G/M296S, R147L, E150H/L/M/P/T, C184R, K186R, K187G/N/Y, M230F/H/I, A231G/R, F233P/Q, Y266F/G, M296R/Y, V297R, W403E/P, V405R, M449G/P, S492P, R590W, and F601A/E/L, wherein the positions are numbered with reference to SEQ ID NO:12.

The present invention also provides non-naturally occurring beta-glucosidase variants, wherein the variants comprise at least one substitution at one or more positions selected from 15, 16, 16/84, 17, 19, 21, 35, 45, 55, 76, 79, 121, 164, 168, 168/256, 170, 179, 215/413, 221, 221/311, 225, 247, 313, 351, 356, 402, 404, 405, 409, 411, 412, 413, and 414, wherein the positions are numbered with reference to SEQ ID NO:14. In some additional embodiments, the non-naturally occurring beta-glucosidase variant comprises at least one substitution selected from 15S, 16A/G, 16S/84H, 17G, 19G, 21A/E/F/G/H/S, 35A/G, 45L, 55P, 76G/L, 76L, 79T, 121S, 164Y, 168E/G/K/L/S, 168Q/256V 170H, 179H/R, 215S/413P, 221C/G/T, 221P/311V, 225H/N/Y, V247G/I/L, 313V, 351A/L, 356, 402K, 404P/S, 405H/W, 409T, 411A/D/G/R/T, 412L, 413A/H/P, and 414D, wherein the positions are numbered with reference to SEQ ID NO:14. In some further embodiments, the non-naturally occurring beta-glucosidase variant comprises at least one substitution selected from A15S, T16A/G, T16S/R84H, A17G, Y19G, I21A/E/F/G/H/S, W35A/G, I45L, C55P, Y76G/L, S79T, H121S, L164Y, W168E/G/K/L/S, W168Q/A256V, S170H, V179H/R, P215S/M413P, V221C/G/T, V221P/A311V, T225H/N/Y, V247G/I/L, R313V, T351A/L, A356G, L402K, N404P/S, F405H/W, M409T, L411A/D/G/R/T, S412L, M413A/H, M413P, and R414D, wherein the positions are numbered with reference to SEQ ID NO:14.

The present invention also provides non-naturally occurring beta-glucosidase variants, wherein the variants comprise an even-numbered sequence provided in SEQ ID NO:22 to SEQ ID NO:294 or SEQ ID NO:344 to SEQ ID NO:360.

The present invention also provides recombinant polynucleotides encoding at least one non-naturally occurring beta-glucosidase variant provided herein. In some embodiments, the recombinant polynucleotide comprises an odd-numbered sequence provided in SEQ ID NO:21 to SEQ ID NO:293 or SEQ ID NO:343 to SEQ ID NO:359. In some additional embodiments, the recombinant polynucleotide encodes a polypeptide comprising an even-numbered sequence provided in SEQ ID NO:22 to SEQ ID NO:294 or SEQ ID NO:344 to SEQ ID NO:360.

The present invention also provides vectors comprising at least one recombinant polynucleotide as provided herein. In some embodiments, the vector further comprises at least one control sequence. In some additional embodiments, the present invention provides host cells comprising at least one recombinant polynucleotide provided herein and/or at least one vector provided herein. In some embodiments, the host cell is selected from eukaryotic and prokaryotic organisms. In some further embodiments, the host cell is *E. coli*.

The present invention also provides methods for producing at least one non-naturally occurring beta-glucosidase variant provided herein, comprising culturing the host cell provided herein under conditions such that the non-naturally occurring beta-glucosidase variant is produced by the host cell. In some embodiments, the methods further comprise the step of recovering the non-naturally occurring beta-glucosidase variant.

The present invention also provides compositions comprising at least one non-naturally occurring beta-glucosidase variant as provided herein.

The present invention also provides methods for converting a glycosyl group acceptor substrate to a beta-glucosylated product, comprising: providing at least one glycosyl group acceptor substrate, at least one glycosyl group donor co-substrate, and at least one beta-glucosidase, included in even numbered SEQ ID NO:1-360, provided herein and/or a composition as provided herein comprising at least one beta-glucosidase provided herein; contacting the glycosyl group acceptor substrate, glycosyl group donor co-substrate, and beta-glucosidase under conditions such that the substrate is glucosylated by the beta-glucosidase to provide a beta-glucosylated product. In some embodiments of the methods, the glycosyl group donor co-substrate is selected from disaccharides, trisaccharides, oligosaccharides, cellobiose, gentiobiose, laminaribiose, and cellulose. In some additional embodiments of the methods, the glycosyl group acceptor substrate is glycosylated. In still some further embodiments of the methods, the glycosyl group acceptor substrate is a naturally-occurring glycosylated substrate. In some yet additional embodiments of the methods, the naturally-occurring glycosylated glycosyl group acceptor substrate is selected from stevioside, rebaudioside A, or rebaudioside D. In still some further embodiments of the methods, the glycosyl group acceptor substrate is a non-naturally occurring glycosylated substrate. In some additional embodiments of the methods, the non-naturally occurring glycosylated substrate comprises 4-methylumbelliferyl N-acetyl-beta-D-glucosaminide. In some further embodiments of the methods, the glycosyl group acceptor substrate is an aglycosylated natural substance. In yet some further embodiments of the methods, the aglycosylated natural substance is resveratrol. In some additional embodiments, the glycosyl group acceptor substrate is a non-naturally occurring aglycosylated substance.

The present invention also provides methods for transglycosylation of a substrate comprising: providing at least one substrate, at least one glycoside hydrolase selected from the even numbered sequences of SEQ ID NO:296 to SEQ ID NO:342; contacting said substrate with said glycoside hydrolase under conditions such that said substrate is transglycosylated to produce at least one transglycosylated product. In some embodiments of the methods, the substrate comprises at least one stevioside. In some additional embodiments of the methods, the transglycosylated product comprises mono-glycosylated and/or diglycosylated products. In yet some further embodiments of the methods, the glycoside hydrolase comprises SEQ ID NO:295 and/or SEQ ID NO:299.

DESCRIPTION OF THE INVENTION

Figure 1:
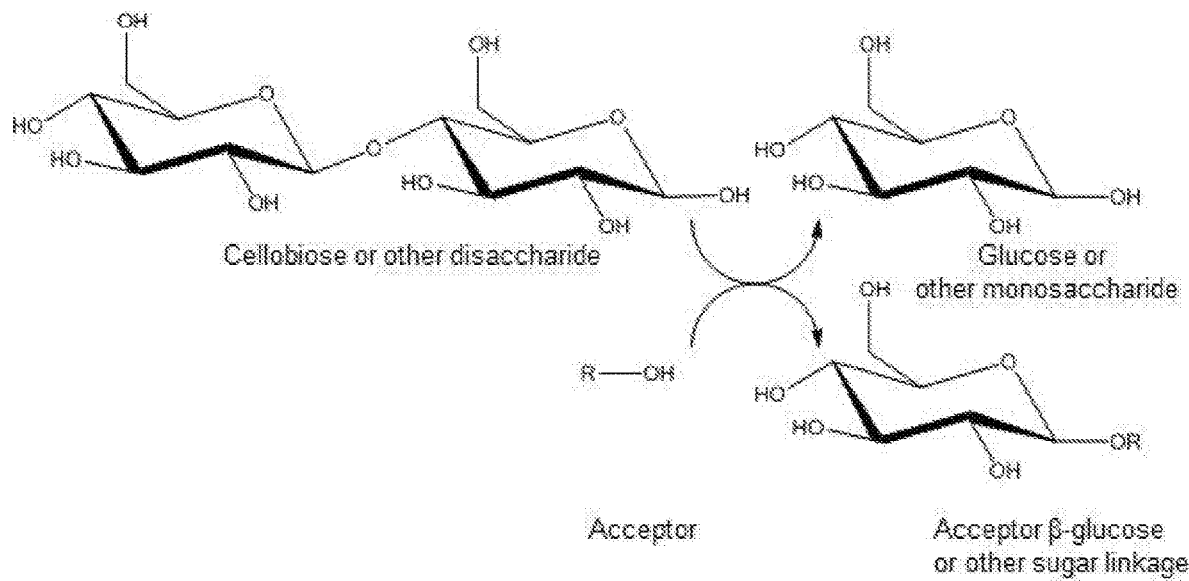
FIG. 1 provides a schematic showing the transglycosylation activity exhibited by some glycosyl transferases wherein the hydroxyl group of a molecule can act as an acceptor of the cleaved sugar in place of water.

The present invention provides engineered β-glucosidase (BGL) enzymes, polypeptides having BGL activity, and polynucleotides encoding these enzymes, as well as vectors and host cells comprising these polynucleotides and polypeptides. The present invention also provides compositions comprising the enzymes, and methods of using the engineered BGL enzymes to make products with β-glucose linkages.

Unless defined otherwise, all technical and scientific terms used herein generally have the same meaning as commonly understood by one of ordinary skill in the art to which this invention pertains. Generally, the nomenclature used herein and the laboratory procedures of cell culture, molecular genetics, microbiology, organic chemistry, analytical chemistry and nucleic acid chemistry described below are those well-known and commonly employed in the art. Such techniques are well-known and described in numerous texts and reference works well known to those of skill in the art. Standard techniques, or modifications thereof, are used for chemical syntheses and chemical analyses. All patents, patent applications, articles and publications mentioned herein, both sup/a and infra, are hereby expressly incorporated herein by reference.

Although any suitable methods and materials similar or equivalent to those described herein find use in the practice of the present invention, some methods and materials are described herein. It is to be understood that this invention is not limited to the particular methodology, protocols, and reagents described, as these may vary, depending upon the context they are used by those of skill in the art. Accordingly, the terms defined immediately below are more fully described by reference to the invention as a whole.

It is to be understood that both the foregoing general description and the following detailed description are exemplary and explanatory only and are not restrictive of the present invention. The section headings used herein are for organizational purposes only and not to be construed as limiting the subject matter described. Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

ABBREVIATIONS

The abbreviations used for the genetically encoded amino acids are conventional and are as follows:

| Amino Acid | Three-Letter Abbreviation | One-Letter Abbreviation |
| --- | --- | --- |
| Alanine | Ala | A |
| Arginine | Arg | R |
| Asparagine | Asn | N |
| Aspartate | Asp | D |
| Cysteine | Cys | C |
| Glutamate | Glu | E |
| Glutamine | Gln | Q |
| Glycine | Gly | G |
| Histidine | His | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

When the three-letter abbreviations are used, unless specifically preceded by an "L" or a "D" or clear from the context in which the abbreviation is used, the amino acid may be in either the L- or D-configuration about α-carbon ($C_\alpha$). For example, whereas "Ala" designates alanine without specifying the configuration about the α-carbon, "D-Ala" and "L-Ala" designate D-alanine and L-alanine, respectively. When the one-letter abbreviations are used, upper case letters designate amino acids in the L-configuration about the α-carbon and lower case letters designate amino acids in the D-configuration about the α-carbon. For example, "A" designates L-alanine and "a" designates D-alanine. When polypeptide sequences are presented as a string of one-letter or three-letter abbreviations (or mixtures thereof), the sequences are presented in the amino (N) to carboxy (C) direction in accordance with common convention.

The abbreviations used for the genetically encoding nucleosides are conventional and are as follows: adenosine (A); guanosine (G); cytidine (C); thymidine (T); and uridine (U). Unless specifically delineated, the abbreviated nucleosides may be either ribonucleosides or 2'-deoxyribonucleosides. The nucleosides may be specified as being either ribonucleosides or 2'-deoxyribonucleosides on an individual basis or on an aggregate basis. When nucleic acid sequences are presented as a string of one-letter abbreviations, the sequences are presented in the 5' to 3' direction in accordance with common convention, and the phosphates are not indicated.

Definitions

In reference to the present invention, the technical and scientific terms used in the descriptions herein will have the meanings commonly understood by one of ordinary skill in the art, unless specifically defined otherwise. Accordingly, the following terms are intended to have the following meanings.

As used herein, the singular forms "a", "an" and "the" include plural referents unless the context clearly indicates otherwise. Thus, for example, reference to "a polypeptide" includes more than one polypeptide.

Similarly, "comprise," "comprises," "comprising" "include," "includes," and "including" are interchangeable and not intended to be limiting. Thus, as used herein, the term "comprising" and its cognates are used in their inclusive sense (i.e., equivalent to the term "including" and its corresponding cognates).

It is to be further understood that where descriptions of various embodiments use the term "comprising," those skilled in the art would understand that in some specific instances, an embodiment can be alternatively described using language "consisting essentially of" or "consisting of."

The term "about" means an acceptable error for a particular value. In some instances "about" means within 0.05%, 0.5%, 1.0%, or 2.0%, of a given value range. In some instances, "about" means within 1, 2, 3, or 4 standard deviations of a given value.

"EC" number refers to the Enzyme Nomenclature of the Nomenclature Committee of the International Union of Biochemistry and Molecular Biology (NC-IUBMB). The IUBMB biochemical classification is a numerical classification system for enzymes based on the chemical reactions they catalyze.

"ATCC" refers to the American Type Culture Collection whose biorepository collection includes genes and strains.

"NCBI" refers to National Center for Biological Information and the sequence databases provided therein.

"Protein," "polypeptide," and "peptide" are used interchangeably herein to denote a polymer of at least two amino acids covalently linked by an amide bond, regardless of length or post-translational modification (e.g., glycosylation or phosphorylation). Included within this definition are D- and L-amino acids, and mixtures of D- and L-amino acids, as well as polymers comprising D- and L-amino acids, and mixtures of D- and L-amino acids.

"Amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes.

As used herein, "polynucleotide" and "nucleic acid" refer to two or more nucleosides that are covalently linked together. The polynucleotide may be wholly comprised of ribonucleotides RNA), wholly comprised of 2' deoxyribonucleotides (i.e., DNA), or comprised of mixtures of ribo- and 2' deoxyribonucleotides. While the nucleosides will typically be linked together via standard phosphodiester linkages, the polynucleotides may include one or more non-standard linkages. The polynucleotide may be single-stranded or double-stranded, or may include both single-stranded regions and double-stranded regions. Moreover, while a polynucleotide will typically be composed of the naturally occurring encoding nucleobases (i.e., adenine, guanine, uracil, thymine and cytosine), it may include one or more modified and/or synthetic nucleobases, such as, for example, inosine, xanthine, hypoxanthine, etc. In some embodiments, such modified or synthetic nucleobases are nucleobases encoding amino acid sequences.

"Coding sequence" refers to that portion of a nucleic acid (e.g., a gene) that encodes an amino acid sequence of a protein.

The term "cellulose" refers to a category of enzymes capable of hydrolyzing cellulose (β-1,4-glucan or β-D-glucosidic linkages) to shorter oligosaccharides, cellobiose and/or glucose. Cellulases include 1,4-β-D-glucan glucanohydrolase ("endoglucariase" or "EG"); 1,4-β-D-glucan cellobiohydrolase ("exoglucanase", "cellobiohydrolase", or "CBH") and β-D-glucoside-glucohydrolase ("β-glucosidase", "cellobiase" or "BG").

As used herein, the terms "biocatalysis," "biocatalytic," "biotransformation," and "biosynthesis" refer to the use of enzymes to perform chemical reactions on organic compounds.

The term "β-glucosidase" or "cellobiase" used interchangeably herein means a β-D-glucoside glucohydrolase which catalyzes the hydrolysis of a sugar dimer, including but not limited to cellobiose, with the release of a corresponding sugar monomer. In one embodiment, a β-glucosidase is a β-glucoside glucohydrolase of the classification E.C. 3.2.1.21 which catalyzes the hydrolysis of cellobiose to glucose. Some of the β-glucosidases have the ability to also hydrolyze β-D-galactosides, β-L-arabinosides and/or β-D-fucosides and further some β-glucosidases can act on α-1, 4-substrates such as starch. β-glucosidase activity may be measured by methods well known in the art, including the assays described herein. β-glucosidases include, but are not limited to, enzymes classified in the GH1, GH3, GH9, and GH30 families.

The term "β-glucosidase polypeptide" refers herein to a polypeptide having β-glucosidase activity.

"Glycoside hydrolases" (GHs), also referred to herein as "glycohydrolases" (EC 3.2.1.), hydrolyze the glycosidic bond between two or more carbohydrates or between a carbohydrate and a non-carbohydrate moiety. The Carbohydrate-Active Enzymes database (CAZy) provides a continuously updated list of the glycoside hydrolase families.

"Glycosyltransferase" refers to a polypeptide having an enzymatic capability of transferring glycosyl residues from an activated nucleotide sugar to monomeric and polymeric acceptor molecules.

As used herein, "transglycosylation" refers to a reaction in which a glycosyl residue is transferred from a disaccharide, trisaccharide, or oligosaccharide donor to an aglycosylated or glycosylated acceptor molecule.

As used herein, "transglycosylation" refers to a transglycosylation reaction in which the glycosyl residue that is transferred is a glucose and the disaccharide, trisaccharide, or oligosaccharide donor contains glucose.

As used herein, "transgalactosylation" refers to a transglycosylation reaction in which the glycosyl residue that is transferred is a galactose and the disaccharide, trisaccharide, or oligosaccharide donor contains galactose.

"Phosphorylase" refers to a polypeptide having an enzymatic capability of cleaving glycosidic bonds using inorganic phosphate, releasing a phosphoglycoside and monomeric or polymeric product. In the reverse direction, a phosphorylase may act as a glycosyltransferase by transferring a glycosyl residue from a phosphoglycoside, for example glucose-1-phosphate, to monomeric and polymeric acceptor.

As used herein, "glycosylation" refers to the formation of a glycosidic linkage between a glycosyl residue and an acceptor molecule.

As used herein, "glucosylation" refers to the formation of a glycosidic linkage between a glucose residue and an acceptor molecule.

As used herein, "glycosyl" refers to an organic group that is a univalent free radical or substituent structure obtained by removing the hemiacetal hydroxyl group from the cyclic form of a monosaccharide, lower oligosaccharide or oligosaccharide derivative. Glycosyl groups react with inorganic acids (e.g., phosphoric acid) to form esters (e.g., glucose 1-phosphate).

As used herein, "glycoside" refers to a molecule in which a carbohydrate (e.g., sugar) is bound to another functional group by a glycosidic bond. Glycosides can be hydrolyzed to produce a sugar and a non-sugar (i.e., aglycone) component.

As used herein, the term "steviol glycoside" refers to a glycoside of steviol, including but not limited to, naturally occurring steviol glycosides (e.g., stevioside, steviolmonoside, steviolbioside, rubusoside, dulcoside B, dulcoside A, rebaudioside B, rebaudioside G, rebaudioside C, rebaudioside F, rebaudioside A, rebaudioside I, rebaudioside E, rebaudioside H, rebaudioside L, rebaudioside K, rebaudioside J, rebaudioside M (also referred to as rebaudioside X), rebaudioside D, rebaudioside N, rebaudioside O), and synthetic steviol glycosides (e.g., enzymatically glucosylated steviol glycosides), and combinations thereof. The chemical structures of steviol and its glycosides are below (See, WO 2013/176738).

Chemical Structures of Steviol and Its Glycosides

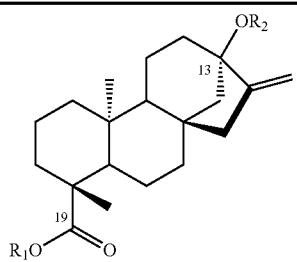

| | | |
|---|---|---|
| Steviol | H | H |
| Steviol-monoside | H | Glcβ1- |
| Steviol monoglucosyl ester | Glcβ1- | H |
| Rubusoside | Glcβ1- | Glcβ1- |
| Steviolbioside | H | Glcβ (1-2) Glcβ1- |
| Dulcoside A | Glcβ1- | Rhaα(1-2) Glcβ1- |
| Stevioside | Glcβ1- | Glcβ (1-2) Glcβ1- |
| Rebaudioside B | H | Glcβ (1-2)[Glcβ (1-3)] Glcβ1- |
| Rebaudioside C | Glcβ1- | Rhaα(1-2)[Glcβ (1-3)] Glcβ1- |
| Rebaudioside A | Glcβ1- | Glcβ (1-2)[Glcβ (1-3)] Glcβ1- |
| Rebaudioside D | Glcβ (1-2) Glcβ1- | Glcβ (1-2)[Glcβ (1-3)] Glcβ1- |
| Rebaudioside M | Glcβ (1-2)[Glcβ (1-3)] Glcβ1- | Glcβ (1-2)[Glcβ (1-3)] Glcβ1- |

(Glc = glucose, Rha = rhamnose)

As used herein, "wild-type" and "naturally-occurring" refer to the form found in nature. For example a wild-type polypeptide or polynucleotide sequence is a sequence present in an organism that can be isolated from a source in nature and which has not been intentionally modified by human manipulation.

As used herein, "recombinant," "engineered," and "non-naturally occurring" when used with reference to a cell, nucleic acid, or polypeptide, refers to a material, or a material corresponding to the natural or native form of the material, that has been modified in a manner that would not otherwise exist in nature. In some embodiments, the cell, nucleic acid or polypeptide is identical a naturally occurring cell, nucleic acid or polypeptide, but is produced or derived from synthetic materials and/or by manipulation using recombinant techniques. Non-limiting examples include, among others, recombinant cells expressing genes that are not found within the native (non-recombinant) form of the cell or express native genes that are otherwise expressed at a different level.

The term "percent (%) sequence identity" is used herein to refer to comparisons among polynucleotides or polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted by any suitable method, including, but not limited to the local homology algorithm of Smith and Waterman (Smith and Waterman, Adv. Appl. Math., 2:482 [1981]), by the homology alignment algorithm of Needleman and Wunsch (Needleman and Wunsch, J. Mol. Biol., 48:443 [1970]), by the search for similarity method of Pearson and Lipman (Pearson and Lipman, Proc. Natl. Acad. Sci. USA 85:2444 [1988]), by computerized implementations of these algorithms (e.g., GAP, BESTFIT, FASTA, and TFASTA in the GCG Wisconsin Software Package), or by visual inspection, as known in the art. Examples of algorithms that are suitable for determining percent sequence identity and sequence similarity include, but are not limited to the BLAST and BLAST 2.0 algorithms, which are described by Altschul et al. (See Altschul et al., J. Mol. Biol., 215: 403-410 [1990]; and Altschul et al., Nucl. Acids Res., 3389-3402 [1977], respectively). Software for performing BLAST analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (See, Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (See, Henikoff and Henikoff, Proc. Natl. Acad. Sci. USA 89:10915 [1989]). Exemplary determination of sequence alignment and % sequence identity can employ the BESTFIT or GAP programs in the GCG Wisconsin Software package (Accelrys, Madison Wis.), using default parameters provided.

"Reference sequence" refers to a defined sequence used as a basis for a sequence and/or activity comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, at least 100 residues in length or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptides are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence.

As used herein, "comparison window" refers to a conceptual segment of at least about 20 contiguous nucleotide positions or amino acid residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

As used herein, "corresponding to," "reference to," and "relative to" when used in the context of the numbering of a given amino acid or polynucleotide sequence refer to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered glycosyltransferase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

As used herein, "substantial identity" refers to a polynucleotide or polypeptide sequence that has at least 80 percent sequence identity, at least 85 percent identity, at least between 89 to 95 percent sequence identity, or more usually, at least 99 percent sequence identity as compared to a reference sequence over a comparison window of at least 20 residue positions, frequently over a window of at least 30-50 residues, wherein the percentage of sequence identity is calculated by comparing the reference sequence to a sequence that includes deletions or additions which total 20 percent or less of the reference sequence over the window of comparison. In some specific embodiments applied to polypeptides, the term "substantial identity" means that two polypeptide sequences, when optimally aligned, such as by the programs GAP or BESTFIT using default gap weights, share at least 80 percent sequence identity, preferably at least 89 percent sequence identity, at least 95 percent sequence identity or more (e.g., 99 percent sequence identity). In some embodiments, residue positions that are not identical in sequences being compared differ by conservative amino acid substitutions.

As used herein, "amino acid difference" and "residue difference" refer to a difference in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X93 as compared to SEQ ID NO:4" refers to a difference of the amino acid residue at the polypeptide position corresponding to position 93 of SEQ ID NO:4. Thus, if the reference polypeptide of SEQ ID NO:4 has a serine at position 93, then a "residue difference at position X93 as compared to SEQ ID NO:4" an amino acid substitution of any residue other than serine at the position of the polypeptide corresponding to position 93 of SEQ ID NO:4. In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some instances (e.g., in Tables 2.1, 3.1, and 5.1), the present invention also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present invention can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X307H/X307P or X307H/P). The slash may also be used to indicate multiple substitutions within a given variant (i.e., there is more than one substitution present in a given sequence, such as in a combinatorial variant). In some embodiments, the present invention includes engineered polypeptide sequences comprising one or more amino acid differences comprising conservative or non-conservative amino acid substitutions. In some additional embodiments, the present invention provides engineered polypeptide sequences comprising both conservative and non-conservative amino acid substitutions.

As used herein, "conservative amino acid substitution" refers to a substitution of a residue with a different residue having a similar side chain, and thus typically involves substitution of the amino acid in the polypeptide with amino acids within the same or similar defined class of amino acids. By way of example and not limitation, in some embodiments, an amino acid with an aliphatic side chain is substituted with another aliphatic amino acid (e.g., alanine, valine, leucine, and isoleucine); an amino acid with an hydroxyl side chain is substituted with another amino acid with an hydroxyl side chain (e.g., serine and threonine); an amino acids having aromatic side chains is substituted with another amino acid having an aromatic side chain (e.g., phenylalanine, tyrosine, tryptophan, and histidine); an amino acid with a basic side chain is substituted with another amino acid with a basis side chain (e.g., lysine and arginine); an amino acid with an acidic side chain is substituted with another amino acid with an acidic side chain (e.g., aspartic acid or glutamic acid); and/or a hydrophobic or hydrophilic amino acid is replaced with another hydrophobic or hydrophilic amino acid, respectively.

As used herein, "non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

As used herein, "deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered glycosyltransferase enzyme. Deletions can be directed to the internal portions and/or terminal portions of the polypeptide. In various embodiments, the deletion can comprise a continuous segment or can be discontinuous.

As used herein, "insertion" refers to modification to the polypeptide by addition of one or more amino acids from the reference polypeptide. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

A "functional fragment" and "biologically active fragment" are used interchangeably herein to refer to a polypeptide that has an amino-terminal and/or carboxy-terminal deletion(s) and/or internal deletions, but where the remaining amino acid sequence is identical to the corresponding positions in the sequence to which it is being compared (e.g., a full-length engineered glycosyltransferase of the present invention) and that retains substantially all of the activity of the full-length polypeptide.

As used herein, "isolated polypeptide" refers to a polypeptide which is substantially separated from other contaminants that naturally accompany it (e.g., protein, lipids, and polynucleotides). The term embraces polypeptides which have been removed or purified from their naturally-occurring environment or expression system (e.g., within a host cell or via in vitro synthesis). The recombinant glycosyltransferase polypeptides may be present within a cell, present in the cellular medium, or prepared in various forms, such as lysates or isolated preparations. As such, in some embodiments, the recombinant glycosyltransferase polypeptides can be an isolated polypeptide.

As used herein, "substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. However, in some embodiments, the composition comprising glycosyltransferase comprises glycosyltransferase that is less than 50% pure (e.g., about 10%, about 20%, about 30%, about 40%, or about 50%) Generally, a substantially pure glycosyltransferase composition comprises about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated recombinant glycosyltransferase polypeptides are substantially pure polypeptide compositions.

As used herein, "improved enzyme property" refers to at least one improved property of an enzyme. In some embodiments, the present invention provides engineered glycosyltransferase polypeptides that exhibit an improvement in any enzyme property as compared to a reference glycosyltransferase polypeptide and/or a wild-type glycosyltransferase polypeptide, and/or another engineered glycosyltransferase polypeptide. Thus, the level of "improvement" can be determined and compared between various glycosyltransferase polypeptides, including wild-type, as well as engineered glycosyltransferases. Improved properties include, but are not limited, to such properties as increased protein expression, increased thermoactivity, increased thermostability, increased pH activity, increased stability, increased enzymatic activity, increased substrate specificity or affinity, increased specific activity, increased resistance to substrate or end-product inhibition, increased chemical stability, improved chemoselectivity, improved solvent stability, increased tolerance to acidic pH, increased tolerance to proteolytic activity (i.e., reduced sensitivity to proteolysis), reduced aggregation, increased solubility, and altered temperature profile.

As used herein, "increased enzymatic activity" and "enhanced catalytic activity" refer to an improved property of the engineered glycosyltransferase polypeptides, which can be represented by an increase in specific activity (e.g., product produced/time/weight protein) or an increase in percent conversion of the substrate to the product (e.g., percent conversion of starting amount of substrate to product in a specified time period using a specified amount of glycosyltransferase) as compared to the reference glycosyltransferase enzyme. Exemplary methods to determine enzyme activity are provided in the Examples. Any property relating to enzyme activity may be affected, including the classical enzyme properties of $K_m$, $V_{max}$ or $k_{cat}$, changes of which can lead to increased enzymatic activity. Improvements in enzyme activity can be from about 1.1 fold the enzymatic activity of the corresponding wild-type enzyme, to as much as 2-fold, 5-fold, 10-fold, 20-fold, 25-fold, 50-fold, 75-fold, 100-fold, 150-fold, 200-fold or more enzymatic activity than the naturally occurring glycosyltransferase or another engineered glycosyltransferase from which the glycosyltransferase polypeptides were derived.

As used herein, "conversion" refers to the enzymatic conversion (or biotransformation) of a substrate(s) to the corresponding product(s). "Percent conversion" refers to the percent of the substrate that is converted to the product within a period of time under specified conditions. Thus, the "enzymatic activity" or "activity" of a glycosyltransferase polypeptide can be expressed as "percent conversion" of the substrate to the product in a specific period of time.

Enzymes with "generalist properties" (or "generalist enzymes") refer to enzymes that exhibit improved activity for a wide range of substrates, as compared to a parental sequence. Generalist enzymes do not necessarily demonstrate improved activity for every possible substrate. In some embodiments, the present invention provides glycosyltransferase variants with generalist properties, in that they demonstrate similar or improved activity relative to the parental gene for a wide range of sterically and electronically diverse substrates. In addition, the generalist enzymes provided herein were engineered to be improved across a wide range of diverse molecules to increase the production of metabolites/products.

The term "stringent hybridization conditions" is used herein to refer to conditions under which nucleic acid hybrids are stable. As known to those of skill in the art, the stability of hybrids is reflected in the melting temperature ($T_m$) of the hybrids. In general, the stability of a hybrid is a function of ion strength, temperature, G/C content, and the presence of chaotropic agents. The $T_m$ values for polynucleotides can be calculated using known methods for predicting melting temperatures (See e.g., Baldino et al., Meth. Enzymol., 168:761-777 [1989]; Bolton et al., Proc. Natl. Acad. Sci. USA 48:1390 [1962]; Bresslauer et al., Proc. Natl. Acad. Sci. USA 83:8893-8897 [1986]; Freier et al., Proc. Natl. Acad. Sci. USA 83:9373-9377 [1986]; Kierzek et al., Biochem., 25:7840-7846 [1986]; Rychlik et al., Nucl. Acids Res., 18:6409-6412 [1990] (erratum, Nucl. Acids Res., 19:698 [1991]); Sambrook et al., supra); Suggs et al., 1981, in *Developmental Biolog Using Purified Genes*, Brown et al. [eds.], pp. 683-693, Academic Press, Cambridge, Mass. [1981]; and Wetmur, Crit. Rev. Biochem. Mol. Biol. 26:227-259 [1991]). In some embodiments, the polynucleotide encodes the polypeptide disclosed herein and hybridizes under defined conditions, such as moderately stringent or highly stringent conditions, to the complement of a sequence encoding an engineered glycosyltransferase enzyme of the present invention.

As used herein, "hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5×Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5×Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w/v) SDS at 65° C. and washing in 0.1×SSC containing 0.1% SDS at 65° C. Other high stringency hybridization conditions, as well as moderately stringent conditions, are described in the references cited above.

As used herein, "codon optimized" refers to changes in the codons of the polynucleotide encoding a protein to those preferentially used in a particular organism such that the encoded protein is efficiently expressed in the organism of interest. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the glycosyltransferase enzymes may be codon optimized for optimal production in the host organism selected for expression.

As used herein, "preferred," "optimal," and "high codon usage bias" codons when used alone or in combination refer(s) interchangeably to codons that are used at higher frequency in the protein coding regions than other codons that code for the same amino acid. The preferred codons may be determined in relation to codon usage in a single gene, a set of genes of common function or origin, highly expressed genes, the codon frequency in the aggregate protein coding regions of the whole organism, codon frequency in the aggregate protein coding regions of related organisms, or combinations thereof. Codons whose frequency increases with the level of gene expression are typically optimal codons for expression. A variety of methods are known for determining the codon frequency (e.g., codon usage, relative synonymous codon usage) and codon preference in specific organisms, including multivariate analysis, for example, using cluster analysis or correspondence analysis, and the effective number of codons used in a gene (See e.g., GCG CodonPreference, Genetics Computer Group Wisconsin Package; CodonW, Peden, University of Nottingham; McInerney, Bioinform., 14:372-73 [1998]; Stenico et al., Nucl. Acids Res., 222437-46 [1994]; Wright, Gene 87:23-29 [1990]). Codon usage tables are available for many different organisms (See e.g., Wada et al., Nucl. Acids Res., 20:2111-2118 [1992]; Nakamura et al., Nucl. Acids Res., 28:292 [2000]; Duret, et al., supra; Henaut and Danchin, in *Escherichia coli* and *Salmonella*, Neidhardt, et al. (eds.), ASM Press, Washington D.C., p. 2047-2066 [1996]). The data source for obtaining codon usage may rely on any available nucleotide sequence capable of coding for a protein. These data sets include nucleic acid sequences actually known to encode expressed proteins (e.g., complete protein coding sequences-CDS), expressed sequence tags (ESTS), or predicted coding regions of genomic sequences (See e.g., Mount, *Bioinformatics: Sequence and Genome Analysis*, Chapter 8, Cold Spring Harbor Laboratory Press, Cold Spring Harbor, N.Y. [2001]; Uberbacher, Meth. Enzymol., 266:259-281 [1996]; and Tiwari et al., Comput. Appl. Biosci., 13:263-270 [1997]).

As used herein, "control sequence" includes all components, which are necessary or advantageous for the expression of a polynucleotide and/or polypeptide of the present invention. Each control sequence may be native or foreign to the nucleic acid sequence encoding the polypeptide. Such control sequences include, but are not limited to, a leader, polyadenylation sequence, propeptide sequence, promoter sequence, signal peptide sequence, initiation sequence and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

"Operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

"Promoter sequence" refers to a nucleic acid sequence that is recognized by a host cell for expression of a polynucleotide of interest, such as a coding sequence. The promoter sequence contains transcriptional control sequences, which mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

The phrase "suitable reaction conditions" refers to those conditions in the enzymatic conversion reaction solution (e.g., ranges of enzyme loading, substrate loading, temperature, pH, buffers, co-solvents, etc.) under which a glycosyltransferase polypeptide of the present invention is capable of converting a substrate to the desired product compound. Some exemplary "suitable reaction conditions" are provided herein.

As used herein, "loading," such as in "compound loading" or "enzyme loading" refers to the concentration or amount of a component in a reaction mixture at the start of the reaction.

As used herein, "substrate" in the context of an enzymatic conversion reaction process refers to the compound or molecule acted on by the glycosyltransferase polypeptide.

As used herein, the terms "biomass," "biomass substrate," "cellulosic biomass," "cellulosic feedstock," and "cellulosic substrate" refer to any materials that contain cellulose. Biomass can be derived from plants, animals, or microorganisms, and may include, but is not limited to agricultural, industrial, and forestry residues, industrial and municipal wastes, and terrestrial and aquatic crops grown for energy purposes. Examples of cellulosic substrates include, but are not limited to, wood, wood pulp, paper pulp, corn fiber, corn grain, corn cobs, crop residues such as corn husks, corn stover, grasses, wheat, wheat straw, barley, barley straw, hay, rice, rice straw, switchgrass, waste paper, paper and pulp processing waste, woody or herbaceous plants, fruit or vegetable pulp, corn cobs, distillers grain, grasses, rice hulls, cotton, hemp, flax, sisal, sugar cane bagasse, sorghum, soy, switchgrass, components obtained from milling of grains, trees, branches, roots, leaves, wood chips, sawdust, shrubs and bushes, vegetables, fruits, and flowers and any suitable mixtures thereof. In some embodiments, the cellulosic biomass comprises, but is not limited to cultivated crops (e.g., grasses, including C4 grasses, such as switch grass, cord grass, rye grass, miscanthus, reed canary grass, or any combination thereof), sugar processing residues, for example, but not limited to, bagasse (e.g., sugar cane bagasse, beet pulp [e.g., sugar beet], or a combination thereof), agricultural residues (e.g. soybean stover, corn stover, corn fiber, rice straw, sugar cane straw, rice, rice hulls, barley straw, corn cobs, wheat straw, canola straw, oat straw, oat hulls, corn fiber, hemp, flax, sisal, cotton, or any combination thereof), fruit pulp, vegetable pulp, distillers' grains, forestry biomass (e.g., wood, wood pulp, paper pulp, recycled wood pulp fiber, sawdust, hardwood, such as aspen wood, softwood, or a combination thereof). Furthermore, in some embodiments, the cellulosic biomass comprises cellulosic waste material and/or forestry waste materials, including but not limited to, paper and pulp processing waste, newsprint, cardboard and the like. In some embodiments, the cellulosic biomass comprises one species of fiber, while in some alternative embodiments, the cellulosic biomass comprises a mixture of fibers that originate from different cellulosic biomasses. In some embodiments, the biomass may also comprise transgenic plants that express ligninase and/or cellulase enzymes (US 2008/0104724 A1).

The terms "lignocellulosic biomass" and "lignocellulosic feedstock" refer to plant biomass that is composed of cellulose and hemicellulose, bound to lignin. The biomass may optionally be pretreated to increase the susceptibility of cellulose to hydrolysis by chemical, physical and biological pretreatments (such as steam explosion, pulping, grinding, acid hydrolysis, solvent exposure, and the like, as well as combinations thereof). Various lignocellulosic feedstocks find use, including those that comprise fresh lignocellulosic feedstock, partially dried lignocellulosic feedstock, fully dried lignocellulosic feedstock, and/or any combination thereof. In some embodiments, lignocellulosic feedstocks comprise cellulose in an amount greater than about 20%, more preferably greater than about 30%, more preferably greater than about 40% (w/w). For example, in some embodiments, the lignocellulosic material comprises from about 20% to about 90% (w/w) cellulose, or any amount therebetween, although in some embodiments, the lignocellulosic material comprises less than about 19%, less than about 18%, less than about 17%, less than about 16%, less than about 15%, less than about 14%, less than about 13%, less than about 12%, less than about 11%, less than about 10%, less than about 9%, less than about 8%, less than about 7%, less than about 6%, or less than about 5% cellulose (w/w). Furthermore, in some embodiments, the lignocellulosic feedstock comprises lignin in an amount greater than about 10%, more typically in an amount greater than about 15% (w/w). In some embodiments, the lignocellulosic feedstock comprises small amounts of sucrose, fructose and/or starch. The lignocellulosic feedstock is generally first subjected to size reduction by methods including, but not limited to, milling, grinding, agitation, shredding, compression/expansion, or other types of mechanical action. Size reduction by mechanical action can be performed by any type of equipment adapted for the purpose, for example, but not limited to, hammer mills, tub-grinders, roll presses, refiners and hydrapulpers. In some embodiments, at least 90% by weight of the particles produced from the size reduction have lengths less than between about 1/16 and about 4 in (the measurement may be a volume or a weight average length). In some embodiments, the equipment used to reduce the particle size reduction is a hammer mill or shredder. Subsequent to size reduction, the feedstock is typically slurried in water, as this facilitates pumping of the feedstock. In some embodiments, lignocellulosic feedstocks of particle size less than about 6 inches do not require size reduction.

As used herein, the term "pretreated lignocellulosic feedstock," refers to lignocellulosic feedstocks that have been subjected to physical and/or chemical processes to make the fiber more accessible and/or receptive to the actions of cellulolytic enzymes, as described above.

A cellulosic substrate or lignocellulosic substrate is said to be "pretreated" when it has been processed by some physical and/or chemical means to facilitate saccharification. As described further herein, in some embodiments, the biomass substrate is "pretreated," or treated using methods known in the art, such as chemical pretreatment (e.g., ammonia pretreatment, dilute acid pretreatment, dilute alkali pretreatment, or solvent exposure), physical pretreatment (e.g., steam explosion or irradiation), mechanical pretreatment (e.g., grinding or milling) and biological pretreatment (e.g., application of lignin-solubilizing microorganisms) and combinations thereof, to increase the susceptibility of cellulose to hydrolysis. Thus, the term "cellulosic biomass" encompasses any living or dead biological material that contains a polysaccharide substrate, including but not limited to cellulose, starch, other forms of long-chain carbohydrate polymers, and mixtures of such sources. It may or may not be assembled entirely or primarily from glucose or xylose, and may optionally also contain various other pentose or hexose monomers. Xylose is an aldopentose containing five carbon atoms and an aldehyde group. It is the precursor to hemicellulose, and is often a main constituent of biomass. In some embodiments, the substrate is slurried prior to pretreatment. In some embodiments, the consistency of the slurry is between about 2% and about 30% and more typically between about 4% and about 15%. In some embodiments, the slurry is subjected to a water and/or acid soaking operation prior to pretreatment. In some embodiments, the slurry is dewatered using any suitable method to reduce steam and chemical usage prior to pretreatment. Examples of dewatering devices include, but are not limited to pressurized screw presses (See e.g., WO 2010/022511, incorporated herein by reference) pressurized filters and extruders.

In some embodiments, the pretreatment is carried out to hydrolyze hemicellulose, and/or a portion thereof present in the cellulosic substrate to monomeric pentose and hexose sugars (e.g., xylose, arabinose, mannose, galactose, and/or any combination thereof). In some embodiments, the pretreatment is carried out so that nearly complete hydrolysis of the hemicellulose and a small amount of conversion of cellulose to glucose occurs. In some embodiments, an acid concentration in the aqueous slurry from about 0.02% (w/w) to about 2% (w/w), or any amount therebetween, is typically used for the treatment of the cellulosic substrate. Any suitable acid finds use in these methods, including but not limited to, hydrochloric acid, nitric acid, and/or sulfuric acid. In some embodiments, the acid used during pretreatment is sulfuric acid. Steam explosion is one method of performing acid pretreatment of biomass substrates (See e.g., U.S. Pat. No. 4,461,648). Another method of pretreating the slurry involves continuous pretreatment (i.e., the cellulosic biomass is pumped though a reactor continuously). This methods are well-known to those skilled in the art (See e.g., U.S. Pat. No. 7,754,457).

In some embodiments, alkali is used in the pretreatment. In contrast to acid pretreatment, pretreatment with alkali may not hydrolyze the hemicellulose component of the biomass. Rather, the alkali reacts with acidic groups present on the hemicellulose to open up the surface of the substrate. In some embodiments, the addition of alkali alters the crystal structure of the cellulose so that it is more amenable to hydrolysis. Examples of alkali that find use in the pretreatment include, but are not limited to ammonia, ammonium hydroxide, potassium hydroxide, and sodium hydroxide. One method of alkali pretreatment is Ammonia Freeze Explosion, Ammonia Fiber Explosion or Ammonia Fiber Expansion ("AFEX" process; See e.g., U.S. Pat. Nos. 5,171,592; 5,037,663; 4,600,590; 6,106,888; 4,356,196; 5,939,544; 6,176,176; 5,037,663 and 5,171,592). During this process, the cellulosic substrate is contacted with ammonia or ammonium hydroxide in a pressure vessel for a sufficient time to enable the ammonia or ammonium hydroxide to alter the crystal structure of the cellulose fibers. The pressure is then rapidly reduced, which allows the ammonia to flash or boil and explode the cellulose fiber structure. In some embodiments, the flashed ammonia is then recovered using methods known in the art. In some alternative methods, dilute ammonia pretreatment is utilized. The dilute ammonia pretreatment method utilizes more dilute solutions of ammonia or ammonium hydroxide than AFEX (See e.g., WO2009/045651 and US 2007/0031953). This pretreatment process may or may not produce any monosaccharides.

Additional pretreatment processes for use in the present invention include chemical treatment of the cellulosic substrate with organic solvents, in methods such as those utilizing organic liquids in pretreatment systems (See e.g., U.S. Pat. No. 4,556,430; incorporated herein by reference). These methods have the advantage that the low boiling point liquids easily can be recovered and reused. Other pretreatments, such as the Organosolv™ process, also use organic liquids (See e.g., U.S. Pat. No. 7,465,791, which is also incorporated herein by reference). Subjecting the substrate to pressurized water may also be a suitable pretreatment method (See e.g., Weil et al., Appl. Biochem. Biotechnol., 68(1-2): 21-40 [1997], which is incorporated herein by reference). In some embodiments, the pretreated cellulosic biomass is processed after pretreatment by any of several steps, such as dilution with water, washing with water, buffering, filtration, or centrifugation, or any combination of these processes, prior to enzymatic hydrolysis, as is familiar to those skilled in the art. The pretreatment produces a pretreated feedstock composition (e.g., a "pretreated feedstock slurry") that contains a soluble component including the sugars resulting from hydrolysis of the hemicellulose, optionally acetic acid and other inhibitors, and solids including unhydrolyzed feedstock and lignin. In some embodiments, the soluble components of the pretreated feedstock composition are separated from the solids to produce a soluble fraction.

In some embodiments, the soluble fraction, including the sugars released during pretreatment and other soluble components (e.g., inhibitors), is then sent to fermentation. However, in some embodiments in which the hemicellulose is not effectively hydrolyzed during the pretreatment one or more additional steps are included (e.g., a further hydrolysis step(s) and/or enzymatic treatment step(s) and/or further alkali and/or acid treatment) to produce fermentable sugars. In some embodiments, the separation is carried out by washing; the pretreated feedstock composition with an aqueous solution to produce a wash stream and a solids stream comprising the unhydrolyzed, pretreated feedstock. Alternatively, the soluble component is separated from the solids by subjecting the pretreated feedstock composition to a solids-liquid separation, using any suitable method (e.g., centrifugation, microfiltration, plate and frame filtration, cross-flow filtration, pressure filtration, vacuum filtration, etc.). Optionally, in some embodiments, a washing step is incorporated into the solids-liquids separation. In some embodiments, the separated solids containing cellulose, then undergo enzymatic hydrolysis with cellulase enzymes in order to convert the cellulose to glucose. In some embodiments, the pretreated feedstock composition is fed into the fermentation process without separation of the solids contained therein. In some embodiments, the unhydrolyzed solids are subjected to enzymatic hydrolysis with cellulase enzymes to convert the cellulose to glucose after the fermentation process. In some embodiments, the pretreated cellulosic feedstock is subjected to enzymatic hydrolysis with cellulase enzymes.

As used herein, the term "slurry" refers to an aqueous solution in which are dispersed one or more solid components, such as a cellulosic substrate.

"Increasing" yield of a product (e.g., a steviol glycoside) from a reaction occurs when a particular component present during the reaction (e.g., a GH enzyme) causes more product to be produced, compared with a reaction conducted under the same conditions with the same substrate and other substituents, but in the absence of the component of interest.

"Hydrolyzing" cellulose or other polysaccharide occurs when at least some of the glycosidic bonds between two monosaccharides present in the substrate are hydrolyzed, thereby detaching from each other the two monomers that were previously bonded.

A reaction is said to be "substantially free" of a particular enzyme if the amount of that enzyme compared with other enzymes that participate in catalyzing the reaction is less than about 2%, about 1%, or about 0.1% (wt/wt).

"Fractionating" a liquid (e.g., a culture broth) means applying a separation process (e.g., salt precipitation, column chromatography, size exclusion, and filtration) or a combination of such processes to provide a solution in which a desired protein (e.g., GH61 protein, cellulase enzyme, or combination thereof) comprises a greater percentage of total protein in the solution than in the initial liquid product.

As used herein, "starting composition" refers to any composition that comprises at least one substrate. In some embodiments, the starting composition comprises any cellulosic substrate.

In some alternative embodiments, the term "starting composition" refers to any composition comprising at least one steviol glycoside, wherein one or more of the steviol glycosides act as substrate(s) for a biotransformation. In some embodiments, the starting composition is provided as an aqueous solution. In some embodiments, the starting composition comprises at least one steviol glycoside selected from stevioside, steviolmonoside, steviolbioside, rubusoside, dulcoside B, dulcoside A, rebaudioside B, rebaudioside G, rebaudioside C, rebaudioside F, rebaudioside A, rebaudioside I, rebaudioside E, rebaudioside H, rebaudioside L, rebaudioside K, rebaudioside J, rebaudioside M (also referred to as rebaudioside X), rebaudioside D, rebaudioside N, rebaudioside O, and synthetic steviol glycosides (e.g., enzymatically glucosylated steviol glycosides). In some embodiments, the starting composition comprises two or more steviol glycosides. In some embodiments, the starting composition comprises an extract obtained from purification of *Stevia rebaudiana* plant material (e.g., leaves). In some alternative embodiments, the starting composition comprises commercially available stevia extract(s). Additional starting compositions comprise by-products of processes used to isolate and purify steviol glycosides. In some embodiments, the starting composition comprises purified or partially purified steviol glycoside substrate(s). In some embodiments, the starting composition comprises greater than about 99% of a particular steviol glycoside by weight.

In some embodiments, the starting composition comprises at least one glycoside and a cellulosic component as the substrate to produce at least one steviol glycoside (e.g., rebaudioside A, D, etc.).

As used herein, "product" in the context of an enzymatic conversion process refers to the compound or molecule resulting from the action of the glycosyltransferase polypeptide on a substrate. In some embodiments, the product provided by the present invention is a steviol glycoside. In some embodiments, the product comprises at least one steviol glycoside selected from stevioside, steviolmonoside, steviolbioside, rubusoside, dulcoside B, dulcoside A, rebaudioside B, rebaudioside G, rebaudioside C, rebaudioside F, rebaudioside A, rebaudioside I, rebaudioside E, rebaudioside H, rebaudioside L, rebaudioside K, rebaudioside J, rebaudioside M (also referred to as rebaudioside X), rebaudioside D, rebaudioside N, rebaudioside O, and synthetic steviol glycosides (e.g., enzymatically glucosylated steviol glycosides), As used herein the term "culturing" refers to the growing of a population of microbial cells under any suitable conditions (e.g., using a liquid, gel or solid medium).

Recombinant polypeptides can be produced using any suitable methods known in the art. Genes encoding the wild-type polypeptide of interest can be cloned in vectors, such as plasmids, and expressed in desired hosts, such as *E. coli*, etc. Variants of recombinant polypeptides can be generated by various methods known in the art. Indeed, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Non-limiting examples of methods used for DNA and protein engineering are provided in the following patents: U.S. Pat. Nos. 6,117,679; 6,420,175; 6,376,246; 6,586,182; 7,747,391; 7,747,393; 7,783,428; and 8,383,346. After the variants are produced, they can be screened for any desired property (e.g., high or increased activity, or low or reduced activity, increased thermal activity, increased thermal stability, and/or acidic pH stability, etc.). In some embodiments, "recombinant glycosyltransferase polypeptides" (also referred to herein as "engineered glycosyltransferase polypeptides," "variant glycosyltransferase enzymes," and "glycosyltransferase variants") find use.

As used herein, a "vector" is a DNA construct for introducing a DNA sequence into a cell. In some embodiments, the vector is an expression vector that is operably linked to a suitable control sequence capable of effecting the expression in a suitable host of the polypeptide encoded in the DNA sequence. In some embodiments, an "expression vector" has a promoter sequence operably linked to the DNA sequence (e.g., transgene) to drive expression in a host cell, and in some embodiments, also comprises a transcription terminator sequence.

As used herein, the term "expression" includes any step involved in the production of the polypeptide including, but not limited to, transcription, post-transcriptional modification, translation, and post-translational modification. In some embodiments, the term also encompasses secretion of the polypeptide from a cell.

As used herein, the term "produces" refers to the production of proteins and/or other compounds by cells. It is intended that the term encompass any step involved in the production of polypeptides including, but not limited to, transcription, post-transcriptional modification, translation, and post-translational modification. In some embodiments, the term also encompasses secretion of the polypeptide from a cell.

As used herein, an amino acid or nucleotide sequence (e.g., a promoter sequence, signal peptide, terminator sequence, etc.) is "heterologous" to another sequence with which it is operably linked if the two sequences are not associated in nature. For example a "heterologous polynucleotide" is any polynucleotide that is introduced into a host cell by laboratory techniques, and includes polynucleotides that are removed from a host cell, subjected to laboratory manipulation, and then reintroduced into a host cell.

As used herein, the terms "host cell" and "host strain" refer to suitable hosts for expression vectors comprising DNA provided herein (e.g., the polynucleotides encoding the glycosyltransferase variants). In some embodiments, the host cells are prokaryotic or eukaryotic cells that have been transformed or transfected with vectors constructed using recombinant DNA techniques as known in the art.

The term "analogue" means a polypeptide having more than 70% sequence identity but less than 100% sequence identity (e.g., more than 75%, 78%, 80%, 83%, 85%, 88%, 90%, 91%, 92%, 93%, 94%, 95%, 96%, 97%, 98%, 99% sequence identity) with a reference polypeptide. In some embodiments, analogues means polypeptides that contain one or more non-naturally occurring amino acid residues including, but not limited, to homoarginine, ornithine and norvaline, as well as naturally occurring amino acids. In some embodiments, analogues also include one or more D-amino acid residues and non-peptide linkages between two or more amino acid residues.

The term "effective amount" means an amount sufficient to produce the desired result. One of general skill in the art may determine what the effective amount by using routine experimentation.

The terms "isolated" and "purified" are used to refer to a molecule (e.g., an isolated nucleic acid, polypeptide, etc.) or other component that is removed from at least one other component with which it is naturally associated. The term "purified" does not require absolute purity, rather it is intended as a relative definition.

"Stereoselectivity" refers to the preferential formation in a chemical or enzymatic reaction of one stereoisomer over another. Stereoselectivity can be partial, where the formation of one stereoisomer is favored over the other, or it may be complete where only one stereoisomer is formed. When the stereoisomers are enantiomers, the stereoselectivity is referred to as enantioselectivity, the fraction (typically reported as a percentage) of one enantiomer in the sum of both. It is commonly alternatively reported in the art (typically as a percentage) as the enantiomeric excess (e.e.) calculated therefrom according to the formula [major enantiomer−minor enantiomer]/[major enantiomer+minor enantiomer]. Where the stereoisomers are diastereoisomers, the stereoselectivity is referred to as diastereoselectivity, the fraction (typically reported as a percentage) of one diastereomer in a mixture of two diastereomers, commonly alternatively reported as the diastereomeric excess (d.e.). Enantiomeric excess and diastereomeric excess are types of stereomeric excess.

"Regioselectivity" and "regioselective reaction" refer to a reaction in which one direction of bond making or breaking occurs preferentially over all other possible directions. Reactions can completely (100%) regioselective if the discrimination is complete, substantially regioselective (at least 75%), or partially regioselective (x %, wherein the percentage is set dependent upon the reaction of interest), if the product of reaction at one site predominates over the product of reaction at other sites.

As used herein, "thermostable" refers to a glycosyltransferase polypeptide that maintains similar activity (more than 60% to 80% for example) after exposure to elevated temperatures (e.g., 40-80° C.) for a period of time (e.g., 0.5-24 h) compared to the wild-type enzyme exposed to the same elevated temperature.

As used herein, "solvent stable" refers to a glycosyltransferase polypeptide that maintains similar activity (more than e.g., 60% to 80%) after exposure to varying concentrations (e.g., 5-99%) of solvent (ethanol, isopropyl alcohol, dimethylsulfoxide [DMSO], tetrahydrofiiran, methyltetrahydrofuran, acetone, toluene, butyl acetate, methyl tert-butyl ether, etc.) for a period of time (e.g., 0.5-24 h) compared to the wild-type enzyme exposed to the same concentration of the same solvent.

As used herein, "thermo- and solvent stable" refers to a glycosyltransferase polypeptide that is both thermostable and solvent stable.

As used herein, "reductant" refers to a compound or agent capable of converting $Fe^{+3}$ to $Fe^{+2}$. An exemplary reductant is ascorbic acid, which is generally in the form of L-ascorbic acid.

As used herein, "optional" and "optionally" mean that the subsequently described event or circumstance may or may not occur, and that the description includes instances where the event or circumstance occurs and instances in which it does not. One of ordinary skill in the art would understand that with respect to any molecule described as containing one or more optional substituents, only sterically practical and/or synthetically feasible compounds are meant to be included. "Optionally substituted" refers to all subsequent modifiers in a term or series of chemical groups.

Glycosylation

Glycosylation can alter many properties of natural and synthetic products including stability, pharmacodynamics, solubility, and membrane transport. The present invention provides compositions, methods and enzymes suitable for generating novel glycosylated compounds from various aglycone and glycosylated substrates. In some embodiments, the present invention provides means to efficiently generate known glycosylated compounds from easily obtained precursors. In some cases, glycosylation is achieved through chemical synthesis methods. However, these methods typically require undesirable chemicals and processes and can result in mixed products (e.g., with linkages in incorrect positions and/or with undesired anomeric configurations). Furthermore, carbohydrate chemistry requires multiple protection and deprotection steps.

In contrast, glycosylating enzymes can be active under mild conditions and can confer high positional selectivity and stereospecificity in a single step. Many naturally derived glycosylated metabolites are generated in vivo using glycosyltransferase (GT) enzymes which transfer sugar moieties from various sugar nucleotides. However, when used in in vitro processes, the sugar nucleotide donors these enzymes require can be prohibitively expensive and may not be available at scale. In addition, the native GT enzyme for a given glycosylation reaction may not be known.

Alternatively, some glycoside hydrolase (GH) enzymes have been shown to have transglycosylation activity wherein the hydroxyl group of a molecule can act as an acceptor of the cleaved sugar in place of water (See, FIG. 1). In this case, substrates act as both the donor and acceptor (e.g., the interconversion of lactose and allolactose catalyzed by LacZ β-galactosidase protein) or the cleaved sugar from one glycosylated substrate is transferred to an alternate acceptor. The latter case has been demonstrated for a variety of hydrolase enzymes (e.g., pullulanase, α-amylase, β-galactosidase, and dextransucrase enzymes) that have been used as transglycosylating enzymes, together with inexpensive pullulan, maltose, lactose, and sucrose, respectively, as glycoside donors.

Many molecules of interest, including many secondary metabolites with antimicrobial, antitumor, natural sweetness properties, etc., that would be good candidates for production via intermolecular transglycosylation are modified with β-glucose linkages. However, most of the enzymes shown to have significant transglycosylation activity generally have α-glucosidase or β-galactosidase activities which result in α-glucose and β-galactose linkages respectively. Therefore, there is a need for an enzyme capable of producing β-glucosylated molecules via intermolecular transglycosylation with inexpensive sugar donors. There are no known biocatalytic routes to produce β-glucosylated compounds and the existing chemical methods known in the art use multistep syntheses. Thus, the present invention meets a need in the art for biocatalysts and processes for using them, under industrially applicable conditions, for the synthesis of β-glucosylated compounds.

In the present invention, β-glucosidase enzymes are provided that are capable of facilitating the intermolecular transglycosylation reaction (See, FIG. 1) between substrates of interest (e.g., stevioside) and inexpensive sugar donors (e.g., cellobiose) to form β-glucose linked products (e.g., rebaudioside A). Additionally, β-glucosidase variants are produced which result in increased transglycosylation and/or decreased hydrolysis of the stevioside substrate. Other non-limiting examples of β-linked glucose donors such as the disaccharides cellobiose, gentiobiose, sophorose, laminaribiose, β,β-trehalose, or β-1,2, β-1,3, β-1,4, β-1,6-linked trioses or further oligosaccharides such as cellotriose, cellatetraose and the like. Thus, the present invention also provides methods for the production of commercially relevant steviol glycosides.

Engineered β-Glucosidase Polypeptides

The present invention provides polypeptides having β-glucosidase activity, polynucleotides encoding the polypeptides, methods of preparing the polypeptides, and methods for using the polypeptides. Where the description relates to polypeptides, it is to be understood that it can describe the polynucleotides encoding the polypeptides.

Suitable reaction conditions under which the above-described improved properties of the engineered polypeptides carry out the glycosylation reaction can be determined with respect to concentrations or amounts of polypeptide, substrate, co-substrate, buffer, solvent, pH, conditions including temperature and reaction time, and/or conditions with the polypeptide immobilized on a solid support, as further described below and in the Examples.

In some embodiments, exemplary engineered polypeptides having β-glucosidase activity with improved properties, particularly in the conversion of glycosides to steviol glycosides comprises an amino acid sequence that has one or more residue differences as compared to SEQ ID NO:12 at the residue positions indicated in Tables 2.1 and 3.1.

In some embodiments, exemplary engineered polypeptides having β-glucosidase activity with improved properties, particularly in the conversion of glycosides to steviol glycosides comprises an amino acid sequence that has one or more residue differences as compared to SEQ ID NO:14 at the residue positions indicated in Table 5.1.

The structure and function information for exemplary non-naturally occurring (or engineered) polypeptides of the present invention are based on the conversion of glycosides to steviol glycosides(s), the results of which are shown below in Tables 2.1, 3.1 and 5.1, and further described in the Examples. The odd numbered sequence identifiers (i.e., SEQ ID NOs) in these Tables refer to the nucleotide sequence encoding the amino acid sequence provided by the even numbered SEQ ID NOs in these tables. Exemplary sequences are provided in the electronic sequence listing file accompanying this invention, which is hereby incorporated by reference herein. The amino acid residue differences are based on comparison to the reference sequence of SEQ ID NOS:12 and 14.

The naturally occurring amino acid sequence of the *B. fragilis* GH3 beta-glucosidase used herein is provided as SEQ ID NO:2 herein (the corresponding polynucleotide sequence is SEQ ID NO:1, as provided herein). The codon-optimized sequences of this polynucleotide is provided as SEQ ID NO:11 (with the corresponding polypeptide sequence as SEQ ID NO:12). The naturally occurring amino acid sequence of the td2f2 GH1 beta-glucosidase used herein is provided as SEQ ID NO:4 herein (the corresponding polynucleotide sequence is SEQ ID NO:3, as provided herein). The codon-optimized sequences of this polynucleotide is provided as SEQ ID NO:13 (with the corresponding polypeptide sequence as SEQ ID NO:14). The naturally occurring amino acid sequence of the *Thermotoga neopoiltana* GH1 beta-glucosidase used herein is provided as SEQ ID NO:6 herein (the corresponding polynucleotide sequence is SEQ ID NO:5, as provided herein). The codon-optimized sequences of this polynucleotide is provided as SEQ ID NO:15 (with the corresponding polypeptide sequence as SEQ ID NO:16). The naturally occurring amino acid sequence of the *Thermobaculum terrenum* GH1 beta-glucosidase used herein is provided as SEQ ID NO:8 herein (the corresponding polynucleotide sequence is SEQ ID NO:7, as provided herein). The codon-optimized sequences of this polynucleotide is provided as SEQ ID NO:17 (with the corresponding polypeptide sequence as SEQ ID NO:18). The naturally occurring GH1 beta-glucosidase of *Clostridium thermocellum* used herein is provided as SEQ ID NO:20 (the corresponding polynucleotide sequence is provided as SEQ ID NO:19). The beta-galactosidase enzyme of *E. coli* (strain K12) used herein is provided as SEQ ID NO:296 herein (the corresponding polynucleotide sequence is provided as SEQ ID NO:295). The naturally occurring beta-galactosidase of *Oryza saliva* subsp. *japonica* used herein is provided as SEQ ID NO:298 the corresponding polynucleotide sequence is provided as SEQ ID NO:297). The codon-optimized sequences of this polynucleotide is provided as SEQ ID NO:299 (with the corresponding polypeptide sequence as SEQ ID NO:300).

The activity of each engineered polypeptide relative to the reference polypeptide of SEQ ID NO:12 or 14 was determined as conversion of the substrates described in the Examples herein. In some embodiments, a shake flask powder (SFP) is used as a secondary screen to assess the properties of the engineered β-glucosidases, the results of which are provided in the Examples. In some embodiments, the SFP forms provide a more purified powder preparation of the engineered polypeptides and can contain the engineered polypeptides that are up to about 30% of total protein.

In some embodiments, the specific enzyme properties are associated with the residues differences as compared to SEQ ID NO:12 and 14 at the residue positions indicated herein. In some embodiments, residue differences affecting polypeptide expression can be used to increase expression of the engineered β-glucosidase.

In light of the guidance provided herein, it is further contemplated that any of the exemplary engineered polypeptides comprising the even-numbered sequences of SEQ ID NOS: 22-294 find use as the starting amino acid sequence for synthesizing other engineered. β-glucosidase polypeptides, for example by subsequent rounds of evolution that incorporate new combinations of various amino acid differences from other polypeptides in Tables 2.1, 3.1, and 5.1, and other residue positions described herein. Further improvements may be generated by including amino acid differences at residue positions that had been maintained as unchanged throughout earlier rounds of evolution.

In some embodiments, the engineered polypeptide having β-glucosidase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:12 and one or more residue differences as compared to SEQ ID NO:12 at residue positions selected from: 31, 32, 34, 36, 37, 38, 57/91, 58, 59, 60, 61, 62, 62/403, 66, 70, 89, 89/187, 91, 91/595, 124, 124/297, 125, 126/188, 133, 138/296, 147, 150, 184, 186, 187, 230, 231, 233, 266, 296, 297, 403, 405, 449, 450, 492, 590, 595, and 601.

In some embodiments, the engineered polypeptide having β-glucosidase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:12 and one or more residue differences as compared to SEQ ID NO:12, selected from: 31C/G, V32G/P/S, 34I/P, 36P, 37K/W, 38E, 57R/91P, 58P, 59R, 60C/R/V, 61R, 62N, 62P/403R, 66G/N, 70W, 89L, 89S/187R, 91G/595V, 124D/297P, 125G, 126V/188R, 133G/R, 138G/296S, 147L, 150H/L/M/P/T, 184A/R, 186E, 187G/N/Y, 230F/H/I, 231G/R, 233L/P/Q, 266F/G, 296R/T, 297R, 403E/P, 405R, 449G/P, 450G, 492P, 590W, 601A/E/L, 601E, and 601L.

In some embodiments, the engineered polypeptide having β-glucosidase activity comprises an amino acid sequence having at least 80%, 85%, 86%, 87%, 88%, 89%, 90%, 91%, 92%, 93%. 94%, 95%, 96%, 97%, 98%, 99% or more sequence identity to reference sequence SEQ ID NO:12 and one or more residue differences as compared to SEQ ID NO:12 at residue positions selected from: 32, 34, 36, 57/91, 58, 59, 60, 62, 62/403, 66, 89, 89/187, 91/595, 124/297, 126/188, 133, 138, 138/296, 147, 150, 184, 186, 187, 188, 230, 231, 233, 266, 296, 297, 403, 405, 449, 492, 590, and 601.

In some embodiments, the engineered polypeptide having β-glucosidase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:12 and one or more residue differences as compared to SEQ ID NO:12, selected from: P31C/G, V32G/P/S, G34I/P, I36P, T37K/W, T38E, G57R/I91P, L58P, F59R, N60C/R/V, L61R, K62N, K62P/W403R, R66G/N, V70W, D89L, D89S/H187R, I91G/G595V, A124D/V297P, S125G, A126V/F188R, F133G/R, D138G/M296S, R147L, E150H/L/M/P/T, C184A/R, K186E, H187G/N/Y, M230F/H/I, A231G/R, F233L/P/Q, Y266F/G, M296R/T, V297R, W403E/P, V405R, M449G/P, F450G, S492P, R590W, and F601A/E/L.

In some embodiments, the engineered polypeptide having β-glucosidase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:12 and one or more residue differences as compared to SEQ ID NO:12, selected from: 32G/P/S, 34I/P, 36P, 57R/91P, 58P, 59R, 60C/R/V, 62N, 62P/403R, 66N, 89L, 89S/187R, 91G/595V, 124D/297P, 126'V/188R, 133G/R, 138G/, 296S, 147L, 150H/L/M/P/T, 184R, 186E, 187G, 187N/Y, 230F/H/I, 231G/R, 233P/Q, 266F/G, 296R/T, 297R, 403E/P, 405R, M449G/P, 492P, 590W, and 601A/E/L.

In some embodiments, the engineered polypeptide having β-glucosidase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:12 and one or more residue differences as compared to SEQ ID NO:12, selected from: V32G/P/S, G34I/P, I36P, G57R/I91P, L58P, F59R, N60C/R/V, K62N, K62P/W403R, R66N, D89L, D89S/H187R, I91G/G595V, A124D/V297P, A126V/F188R, F133G/R, D138G/M296S, R147L, E150H/L/M/P/T, C184R, K186E, H187G/N/Y, M230F/H/I, A231G/R, F233P/Q, Y266F/G, M296R/Y, V297R, W403E/P, V405R, M449G/P, S492P, R590W, and F601A/E/L.

In some embodiments, the engineered polypeptide having β-glucosidase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:12 and comprises an even numbered sequences between SEQ ID NOS:22 and 172.

In some embodiments, the engineered polypeptide having activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:14 and one or more residue differences as compared to SEQ ID NO:14 at residue positions selected from: 15, 16, 16/84, 17, 19, 21, 35, 45, 55, 76, 79, 121, 164, 168, 168/256, 170, 179, 215/413, 221, 221/311, 225, 247, 313, 351, 356, 402, 404, 405, 409, 411, 412, 413, and 414.

In some embodiments, the engineered polypeptide having activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:14 and one or more residue differences as compared to SEQ ID NO:14, selected from: 15S, 16A/G, 165/84H, 17G, 19G, 21A/E/F/G/H/S, 35A/G, 45L, 55P, 76G/L, 76L, 79T, 121S, 164Y, 168E/G/K/L/S, 168Q/256V. 170H, 179H/R, 215S/413P, 221C/G/T, 221P/311V, 225H/N/Y, V247G/I/L, 313V, 351A/L, 356, 402K, 404P/S, 405H/W, 409T, 411A/D/G/R/T, 412L, 413A/H/P, and 414D.

In some embodiments, the engineered polypeptide having activity comprises an amino acid sequence having at least 80%, 85%, 86%, 87%, 88%, 89%, 90%, 1%, 92%, 93%, 94%, 95%, 96%, 97%, 98%, 99% or more sequence identity to reference sequence SEQ ID NO:14 and one or more residue differences as compared to SEQ ID NO:14, selected from: A15S, T16A/G, T16S/R84H, A17G, Y19G, I21A/E/F/G/H/S, W35A/G, I45L, C55P, Y76G/L, S79T, H121S, L164Y, W168E/G/K/L/S, W168Q/A256V, S170H, V179H/R, P215S/M413P, V221C/G/T, V221P/A311V, T225H/N/Y, V247G/I/L, R313V, T351A/L, A356G, L402K, N404P/S, F405H/W, M409T, L411A/D/G/R/T, S412L, M413A/H, M413P, and R414D.

In some embodiments, the engineered polypeptide having β-glucosidase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence NO:14 and comprises an even numbered sequences between SEQ ID NOS: 174 and 294.

As will be appreciated by the skilled artisan, in some embodiments, one or a combination of residue differences above that is selected can be kept constant (i.e., maintained) the engineered β-glucosidase as a core feature, and additional residue differences at other residue positions incorporated into the sequence to generate additional engineered β-glucosidase polypeptides with improved properties. Accordingly, it is to be understood for any engineered β-glucosidase containing one or a subset of the residue differences above, the present invention contemplates other engineered β-glucosidases that comprise the one or subset of the residue differences, and additionally one or more residue differences at the other residue positions disclosed herein.

As noted above, the engineered polypeptides having β-glucosidase activity are also capable of converting substrates (e.g., glycosides and cellobiose) to products (e.g., steviol glycosides). In some embodiments, the engineered β-glucosidase polypeptide is capable of converting the substrate to the product compound with at least 1.2 fold, 1.5 fold, 2 fold, 3 fold, 4 fold, 5 fold, 10 fold, 20 fold, 30 fold, 40 fold, 50 fold, 60 fold, 70 fold, 80 fold, 90 fold, 100 fold, or more activity relative to the activity of the reference polypeptide of SEQ ID NO:12, 14, 296, or 298.

In some embodiments, the engineered β-glucosidase polypeptide capable of converting the substrate compounds to the product compounds with at least 2 fold the activity relative to SEQ ID NO:12 and/or 14, comprises an amino acid sequence selected from: the even-numbered sequences in SEQ ID NOS:22 to 194.

In some embodiments, the engineered β-glucosidase has an amino acid sequence comprising one or more residue differences as compared to SEQ ID NO:12, and/or 14, that increase expression of the engineered β-glucosidase activity in a bacterial host cell, particularly in *E. coli*.

In some embodiments, the engineered β-glucosidase polypeptide with improved properties has an amino acid sequence comprising a sequence selected from the even-numbered sequences in the range: SEQ ID NOS:22 to 294.

In some embodiments, the engineered polypeptide having β-glucosidase activity, comprises an amino acid sequence having at least 80%, 85%, 86%, 87%, 88%, 89%, 90%, 91%, 92%, 93%, 94%, 95%, 96%, 97%, 98%, or 99% identity to one of the even-numbered sequences in the range: SEQ ID NOS:22-294, and the amino acid residue differences as compared to SEQ ID NO:12 and/or 14, present in any one of the even-numbered sequences in the range: SEQ ID NOS:22-294, as provided in the Examples.

In addition to the residue positions specified above, any of the engineered β-glucosidase polypeptides disclosed herein can further comprise other residue differences relative to SEQ ID NO:12, 14, 296, 298, and/or 300, at other residue positions (i.e., residue positions other than those included herein). Residue differences at these other residue positions can provide for additional variations in the amino acid sequence without adversely affecting the ability of the polypeptide to carry out the conversion of substrate to product. Accordingly, in some embodiments, in addition to the amino acid residue differences present in any one of the engineered β-glucosidase polypeptides selected from the even-numbered sequences in the range: SEQ ID NOS:22-294, the sequence can thither comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, or 1-50 residue differences at other amino acid residue positions as compared to the SEQ ID NO:12, 14, 296, 298, and/or 300. In some embodiments, the number of amino acid residue differences as compared to the reference sequence can be 1, 2, 3, 4, 5, 6, 7, 8, 9, 10, 11, 12, 13, 14, 15, 16, 17, 18, 19, 20, 21, 22, 23, 24, 25, 30, 30, 35, 40, 45 or 50 residue positions. In some embodiments, the number of amino acid residue differences as compared to the reference sequence can be 1, 2, 3, 4, 5, 6, 7, 8, 9, 10, 11, 12, 13, 14, 15, 16, 18, 20, 21, 22, 23, 24, or 25 residue positions. The residue difference at these other positions can be conservative changes or non-conservative changes. In some embodiments, the residue differences can comprise conservative substitutions and non-conservative substitutions as compared to the naturally occurring β-glucosidase polypeptide of SEQ ID NOS:12, 14, 296, 298, and/or 300.

In some embodiments, the present invention also provides engineered polypeptides that comprise a fragment of any of the engineered β-glucosidase polypeptides described herein that retains the functional activity and/or improved property of that engineered β-glucosidase. Accordingly, in some embodiments, the present invention provides a polypeptide fragment capable of converting substrate to product under suitable reaction conditions, wherein the fragment comprises at least about 80%, 90%, 95%, 96%, 97%, 98%, or 99% of a full-length amino acid sequence of an engineered β-glucosidase polypeptide of the present invention, such as an exemplary engineered β-glucosidase polypeptide selected from the even-numbered sequences in the range: SEQ ID NOS:22-294. In some embodiments, the engineered β-glucosidase polypeptide can have an amino acid sequence comprising a deletion in any one of the engineered β-glucosidase polypeptide sequences described herein, such as the exemplary engineered polypeptides of the even-numbered sequences in the range: SEQ ID NOS:22-294.

Thus, for each and every embodiment of the engineered β-glucosidase polypeptides of the invention, the amino acid sequence can comprise deletions of one or more amino acids, 2 or more amino acids, 3 or more amino acids, 4 or more amino acids, 5 or more amino acids, 6 or more amino acids, 8 or more amino acids, 10 or more amino acids, 15 or more amino acids, or 20 or more amino acids, up to 10% of the total number of amino acids, up to 20% of the total number of amino acids, or up to 30% of the total number of amino acids of the β-glucosidase polypeptides, where the associated functional activity and/or improved properties of the engineered β-glucosidase described herein are maintained. In some embodiments, the deletions can comprise 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residues. In some embodiments, the number of deletions can be 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residues. In some embodiments, the deletions can comprise deletions of 1, 2, 3, 4, 5, 6, 7, 8, 9, 10, 11, 12, 13, 14, 15, 16, 18, 20, 21, 22, 23, 24, or 25 amino acid residues.

In some embodiments, the engineered β-glucosidase polypeptide herein can have an amino acid sequence comprising an insertion as compared to any one of the engineered β-glucosidase polypeptides described herein, such as the exemplary engineered polypeptides of the even-numbered sequences in the range: SEQ ID NOS:22-294. Thus, for each and every embodiment of the β-glucosidase polypeptides of the invention, the insertions can comprise one or more amino acids, 2 or more amino acids, 3 or more amino acids, 4 or more amino acids, 5 or more amino acids, 6 or more amino acids, 8 or more amino acids, 10 or more amino acids, 15 or more amino acids, 20 or more amino acids, 30 or more amino acids, 40 or more amino acids, or 50 or more amino acids, where the associated functional activity and/or improved properties of the engineered β-glucosidase described herein is maintained. The insertions can be to amino or carboxy terminus, or internal portions of the β-glucosidase polypeptide.

In some embodiments, the engineered β-glucosidase polypeptide herein can have an amino acid sequence comprising a sequence selected from the even-numbered sequences in the range: SEQ ID NOS:22-294, and optionally one or several (e.g., up to 3, 4, 5, or up to 10) amino acid residue deletions, insertions and/or substitutions. In some embodiments, the amino acid sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residue deletions, insertions and/or substitutions. In some embodiments, the number of amino acid sequence has optionally 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions can be conservative or non-conservative substitutions.

In the above embodiments, the suitable reaction conditions for the engineered polypeptides are provided in Tables 2.1, 3.1, and/or 5.1, and as described in Examples 2, 3, and 5, as well as the other Examples.

In some embodiments, the polypeptides of the present invention are fusion polypeptides in which the engineered polypeptides are fused to other polypeptides, such as, by way of example and not limitation, antibody tags (e.g., myc epitope), purification sequences (e.g., His tags for binding to metals), and cell localization signals secretion signals). Thus, the engineered polypeptides described herein can be used with or without fusions to other polypeptides.

It is to be understood that the polypeptides described herein are not restricted to the genetically encoded amino acids. In addition to the genetically encoded amino acids, the polypeptides described herein may be comprised, either in whole or in part, of naturally occurring and/or synthetic non-encoded amino acids. Certain commonly encountered non-encoded amino acids of which the polypeptides described herein may be comprised include, but are not limited to: the D-stereomers of the genetically-encoded amino acids; 2,3-diaminopropionic acid (Dpr); α-aminoisobutyric acid (Aib); ε-aminohexanoic acid (Aha); δ-aminovaleric acid (Ava); N-methylglycine or sarcosine (MeGly or Sar); ornithine (Orn); citrulline (Cit); t-butylalanine (Bua); t-butylglycine (Bug); N-methylisoleucine (MeIle); phenylglycine (Phg); cyclohexylalanine (Cha); norleucine (Nle); naphthylalanine (Nal); 2-chlorophenylalanine (Ocf); 3-chlorophenylalanine (Mcf); 4-chlorophenylalanine (Pcf); 2-fluorophenylalanine (Off); 3-fluorophenylalanine (Mff); 4-fluorophenylalanine (Pff); 2-bromophenylalanine (Obf); 3-bromophenytalanine (Mbf); 4-bromophenytalanine (Pbf); 2-methylphenylalanine (Omf); 3-methylphenylalanine (Mmf); 4-methylphenytalanine (Pmf); 2-nitrophenylalanine (Onf); 3-nitrophenylalanine (Mnf); 4-nitrophenylalanine (Pnf); 2-cyanophenylalanine (Ocf); 3-cyanophenylalanine (Mcf); 4-cyanophenylalanine (Pcf); 2-trifluoromethylphenylalanine (Otf); 3-trifluoromethylphenylalanine (Mtf); 4-trifluoromethylphenylalanine (Ptf); 4-aminophenylalanine (Paf); 4-iodophenylalanine (Pif); 4-aminomethylphenylalanine (Pamf); 2,4-dichlorophenylalanine (Opef); 3,4-dichlorophenylalanine (Mpcf); 2,4-difluorophenylalanine (Opff); 3,4-difluorophenylalanine (Mpff); pyrid-2-ylalanine (2pAla); pyrid-3-ylalanine (3pAla); pyrid-4-ylalanine (4pAla); naphth-1-ylalanine (1nAla); naphth-2-ylalanine (2nAla); thiazolytalanine (taAla); benzothienlalanine (bAla); thienylalanine (tAla); furylalanine (fAla); homophenylalanine (hPhe); homotyrosine (hTyr); homotryptophan (hTrp); pentafluorophenylalanine (5ff); styrylkalanine (sAla); authrylalanine (aAla); 3,3-diphenylalanine (Dfa); 3-amino-5-phenypentanoic acid (Afp); penicillamine (Pen); 1,2,3,4-tetrahydmisoquinoline-3-carboxylic acid (Tic); β-2-thienylalanine (Thi); methionine sulfoxide (Mso); N(w)-nitroarginine (nArg); homolysine (hLys); phosphonomethylphenylalanine (pmPhe); phosphoserine (pSer); phosphothreonine (pThr); homoaspartic acid (hAsp); homoglutanic acid (hGlu); 1-aminocyclopent-(2 or 3)-ene-4 carboxylic acid; pipecolic acid (PA), azetidine-3-carboxylic acid (ACA); 1-aminocyclopentane-3-carboxylic acid; allylglycine (aGly); propargylglycine (pgGly); homoalanine (hAla); norvaline (nVal); homoleucine (hLeu), homovaline (hVal); homoisoleucine (hIle); homoarginine (hArg); N-acetyl lysine (AcLys); 2,4-diaminobutyric acid (Dbu); 2,3-diaminobutyric acid (Dab); N-methylvaline (MeVal); homocysteine (hCys); homoserine (hSer); hydroxyproline (Hyp) and homoproline (hPro). Additional non-encoded amino acids of which the polypeptides described herein may be comprised will be apparent to those of skill in the art (See e.g., the various amino acids provided in Fasman, *CRC Practical Handbook of Biochemistry and Molecular Biology*, CRC Press, Boca Raton, Fla., pp. 3-70 [1989], and the references cited therein, all of which are incorporated by reference). These amino acids may be in either the L- or D-configuration.

Those of skill in the art will recognize that amino acids or residues bearing side chain protecting groups may also comprise the polypeptides described herein. Non-limiting examples of such protected amino acids, which in this case belong to the aromatic category, include (protecting groups listed in parentheses), but are not limited to: Arg(tos), Cys(methylbenzyl), Cys (ntropyridinesulfenyl), Glu(δ-benzylester), Gln(xanthyl), Asn(N-δ-xanthyl), His(bom), His (benzyl), His(tos), Lys(fmoc), Lys(tos), Ser(O-benzyl), Thr (O-benzyl) and Tyr(O-benzyl).

Non-encoding amino acids that are conformationally constrained of which the polypeptides described herein may be composed include, but are not limited to, N-methyl amino acids (L-configuration); 1-aminocyclopent-(2 or 3)-ene-4-carboxylic acid; pipecolic acid; azetidine-3-carboxylic acid; homoproline (hPro); and 1-aminocyclopentane-3-carboxylic acid.

In some embodiments, the engineered polypeptides can be in various forms, for example, such as an isolated preparation, as a substantially purified enzyme, whole cells transformed with gene(s) encoding the enzyme, and/or as cell extracts and/or lysates of such cells. The enzymes can be lyophilized, spray-dried, precipitated or be in the form of a crude paste, as further discussed below.

In some embodiments, the engineered polypeptides can be provided on a solid support, such as a membrane, resin, solid carrier, or other solid phase material. A solid support can be composed of organic polymers such as polystyrene, polyethylene, polypropylene, polyfluoroethylene, polyethyleneoxy, and polyacrylamide, as well as co-polymers and grafts thereof. A solid support can also be inorganic, such as glass, silica, controlled pore glass (CPG), reverse phase silica or metal, such as gold or platinum. The configuration of a solid support can be in the form of beads, spheres, particles, granules, a gel, a membrane or a surface. Surfaces can be planar, substantially planar, or non-planar. Solid supports can be porous or non-porous, and can have swelling or non-swelling characteristics. A solid support can be configured in the form of a well, depression, or other container, vessel, feature, or location.

In some embodiments, the engineered polypeptides having β-glucosidase activity of the present invention can be immobilized on a solid support such that they retain their improved activity, and/or other improved properties relative to the reference polypeptide of SEQ ID NO: 12 and/or 14. In such embodiments, the immobilized polypeptides can facilitate the biocatalytic conversion of the substrate compounds or other suitable substrates to the product and after the reaction is complete are easily retained (e.g., by retaining beads on which polypeptide is immobilized) and then reused or recycled in subsequent reactions. Such immobilized enzyme processes allow for further efficiency and cost reduction. Accordingly, it is further contemplated that any of the methods of using the β-glucosidase polypeptides of the present invention can be carried out using the same β-glucosidase polypeptides bound or immobilized on a solid support.

Methods of enzyme immobilization are well-known in the art. The engineered polypeptides can be bound non-covalently or covalently. Various methods for conjugation and immobilization of enzymes to solid supports (e.g., resins, membranes, beads, glass, etc.) are well known in the art (See e.g., Yi et al., Proc. Biochem., 42(5): 895-898 [2007]; Martin et al, Appl. Microbiol. Biotechnol., 76(4): 843-851 [2007]; Koszelewski et al., J. Mol. Cat. B: Enzymatic, 63: 39-44 [2010]; Truppo et al., Org. Proc. Res, Dev., published online: dx.doi.org/10.1021/op200157c; Hermanson, *Bioconjugate Techniques*, 2$^{nd}$ ed., Academic Press, Cambridge, Mass. [2008]; Mateo et al., Biotechnol. Prog., 18(3):629-34 [2002]; and "Bioconjugation Protocols: Strategies and Methods," In *Methods in Molecular Biology*, Niemeyer (ed.), Humana Press, New York, N.Y. [2004]; the disclosures of each which are incorporated by reference herein). Solid supports useful for immobilizing the engineered glucosidases of the present invention include but are not limited to beads or resins comprising polymethacrylate with epoxide functional groups, polymethacrylate with amino epoxide functional groups, styrene/DVB copolymer or polymethacrylate with octadecyl functional groups. Exemplary solid supports useful for immobilizing the engineered β-glucosidase polypeptides of the present invention include, but are not limited to, chitosan beads, Eupergit C, and SEPABEADs (Mitsubishi), including the following different types of SEPABEAD: EC-EP, EC-HFA/S, EXA252, EXE119 and EXE120.

In some embodiments, the polypeptides described herein are provided in the form of kits. The enzymes in the kits may be present individually or as a plurality of enzymes. The kits can further include reagents for carrying out the enzymatic reactions, substrates for assessing the activity of enzymes, as well as reagents for detecting the products. The kits can also include reagent dispensers and instructions for use of the kits.

In some embodiments, the kits of the present invention include arrays comprising a plurality of different β-glucosidase polypeptides at different addressable position, wherein the different polypeptides are different variants of a reference sequence each having at least one different improved enzyme property. In some embodiments, a plurality of polypeptides immobilized on solid supports are configured on an array at various locations, addressable for robotic delivery of reagents, or by detection methods and/or instruments. The array can be used to test a variety of substrate compounds for conversion by the polypeptides. Such arrays comprising a plurality of engineered polypeptides and methods of their use are known in the art (See e.g., WO2009/008908A2).

Polynucleotides Encoding Engineered
β-glucosidases, Expression Vectors and Host Cells In another aspect, the present invention provides polynucleotides encoding the engineered β-glucosidase polypeptides described herein. The polynucleotides may be operatively linked to one or more heterologous regulatory sequences that control gene expression to create a recombinant polynucleotide capable of expressing the polypeptide. Expression constructs containing a heterologous polynucleotide encoding the engineered β-glucosidase are introduced into appropriate host cells to express the corresponding β-glucosidase polypeptide.

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode the improved β-glucosidase enzymes. Thus, having knowledge of a particular amino acid sequence, those skilled in the art could make any number of different nucleic acids by simply modifying the sequence of one or more codons in a way which does not change the amino acid sequence of the protein. In this regard, the present invention specifically contemplates each and every possible variation of polynucleotides that could be made encoding the polypeptides described herein by selecting combinations based on the possible codon choices, and all such variations are to be considered specifically disclosed for any polypeptide described herein, including the amino acid sequences presented in Tables 2.1, 3.1, and 5.1. and disclosed in the sequence listing incorporated by reference herein as the even-numbered sequences in the range: SEQ ID NOS:22-294.

In various embodiments, the codons are preferably selected to fit the host cell in which the protein is being produced. For example, preferred codons used in bacteria are used to express the gene in bacteria; preferred codons used in yeast are used for expression in yeast; and preferred codons used in mammals are used for expression in mammalian cells. In some embodiments, all codons need not be replaced to optimize the codon usage of the β-glucosidases since the natural sequence will comprise preferred codons and because use of preferred codons may not be required for all amino acid residues. Consequently, codon optimized polynucleotides encoding the β-glucosidase enzymes may contain preferred codons at about 40%, 50%, 60%, 70%, 80%, or greater than 90% of codon positions of the full length coding region.

In some embodiments, the polynucleotide comprises a codon optimized nucleotide sequence encoding the naturally occurring β-glucosidase polypeptide amino acid sequence, as represented by SEQ ID NO:12, 14, 296, and/or 298. In some embodiments, the polynucleotide has a nucleic acid sequence comprising at least 80%, 85%, 90%, 91%, 92%, 93%, 94%, 95%, 96%, 97%, 98%, 99% or more identity to the codon optimized nucleic acid sequences encoding the even-numbered sequences in the range: SEQ ID NOS:22-294. In some embodiments, the polynucleotide has a nucleic acid sequence comprising at least 80%, 85%, 90%. 91%, 92%, 93%, 94%, 95%, 96%, 97%, 98%, 99% or more identity to the codon optimized nucleic acid sequences in the odd-numbered sequences in the range: SEQ ID NOS:21-293, as well as SEQ ID NOS:11, 13, 15, 17, and 19. In some embodiments, the codon optimized sequences of the odd-numbered sequences in the range: SEQ ID NOS:21-293, as well as SEQ ID NOS:11, 13, 15, 17, and 19, enhance expression of the encoded, wild-type β-glucosidase, providing preparations of enzyme capable of converting substrate to product.

In some embodiments, the polynucleotides are capable of hybridizing under highly stringent conditions to a reference sequence selected from the odd-numbered sequences in SEQ ID NOS:3-299, or a complement thereof, and encodes a polypeptide having β-glucosidase activity.

In some embodiments, as described above, the polynucleotide encodes an engineered polypeptide having β-glucosidase activity with improved properties as compared to SEQ ID NO:12 and/or 14, wherein the polypeptide comprises an amino acid sequence having at least 80%, 85%, 86%, 87%, 88%, 89%, 90%, 91%, 92%, 93%, 94%, 93%, 96%, 97%, 98%, 99% or more identity to a reference sequence selected from SEQ ID NO:12 and/or 14, and one or more residue differences as compared to SEQ ID NO:12 and/or 14, wherein the sequence is selected from the even-numbered sequences in the range: SEQ ID NOS:22-294. In some embodiments, the reference amino acid sequence is selected from the even-numbered sequences in the range: SEQ ID NOS:22-294. In some embodiments, the reference amino acid sequence is SEQ ID NO:12, while in some other embodiments, the reference sequence is SEQ ID NO:14.

In some embodiments, the polynucleotide encodes a β-glucosidase polypeptide capable of converting substrate to product with improved properties as compared to SEQ ID NO:12, 14, 296, and/or 300, wherein the polypeptide comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:12, 14, 296, and/or 300.

In some embodiments, the polynucleotide encoding the engineered β-glucosidase comprises art polynucleotide sequence selected from the odd-numbered sequences in the range: SEQ ID NOS:21-293.

In some embodiments, the polynucleotides are capable of hybridizing under highly stringent conditions to a reference polynucleotide sequence selected from the odd-numbered sequences in the range: SEQ ID NOS:21-293, or a complement thereof, and encodes a polypeptide having β-glucosidase activity with one or more of the improved properties described herein. In some embodiments, the polynucleotide capable of hybridizing under highly stringent conditions encodes a β-glucosidase polypeptide comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO:12, that has an amino acid sequence comprising one or more residue differences as compared to SEQ ID NO:12, at residue positions selected from: 31, 32, 34, 36, 37, 38, 57/91, 58, 59, 60, 61, 62, 62/403, 66, 70, 89, 89/187, 91/595, 124/297, 125, 126/188, 133, 138/296, 147, 150, 184, 186, 187, 230, 231, 233, 266, 296, 297, 403, 405, 449, 450, 492, 590, and 601.

In some embodiments, the polynucleotides are capable of hybridizing under highly stringent conditions to a reference polynucleotide sequence selected from the odd-numbered sequences in the range: SEQ ID NOS:21-293, or a complement thereof, and encodes a polypeptide having β-glucosidase activity with one or more of the improved properties described herein. In some embodiments, the polynucleotide capable of hybridizing under highly stringent conditions encodes a β-glucosidase polypeptide comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO:12, that has an amino acid sequence comprising one or more residue differences as compared to SEQ ID NO:12, at residue positions selected from: 32, 34, 36, 57/91, 58, 59, 60, 62, 62/403, 66, 89, 89/187, 91/595, 124/297, 126/188, 133, 138/296, 147, 150, 184, 186, 187, 230, 231, 233, 266, 296, 297, 403, 405, 449, 492, 590, and 601.

In some embodiments, the polynucleotide capable of hybridizing under highly stringent conditions encodes an engineered polypeptide having β-glucosidase activity with improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO:14, and one or more residue differences as compared to SEQ ID NO:14 at residue positions selected from 15, 16, 16/84, 17, 19, 21, 35, 45, 55, 76, 79, 121, 164, 168, 168/256, 170, 179, 215/413, 221, 221/311, 225, 247, 313, 351, 356, 402, 404, 405, 409, 411, 412, 413, and 414.

In some embodiments, the polynucleotide, capable of hybridizing under highly stringent conditions encodes an engineered polypeptide having β-glucosidase activity with improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO:296 and/or 298. In some embodiments, the polynucleotides encode the polypeptides described herein but have at least about 80%, 85%, 86%, 87%, 88%, 89%, 90%, 91%, 92%, 93%, 94%, 95%, 96%, 97%, 98%, or 99% or more sequence identity at the nucleotide level to a reference polynucleotide encoding the engineered β-glucosidase. In some embodiments, the reference polynucleotide sequence is selected from SEQ ID NOS:21-293.

In some embodiments, an isolated polynucleotide encoding any of the engineered β-glucosidase polypeptides provided herein is manipulated in a variety of ways to provide for expression of the polypeptide. In some embodiments, the polynucleotides encoding the polypeptides are provided as expression vectors where one or more control sequences is present to regulate the expression of the polynucleotides and/or polypeptides. Manipulation of the isolated polynucleotide prior to its insertion into a vector may be desirable or necessary depending on the expression vector. The techniques for modifying polynucleotides and nucleic acid sequences utilizing recombinant DNA methods are well known in the art.

In some embodiments, the control sequences include among other sequences, promoters, leader sequences, polyadenylation sequences, propeptide sequences, signal peptide sequences, and transcription terminators. As known in the art, suitable promoters can be selected based on the host cells used. For bacterial host cells, suitable promoters for directing transcription of the nucleic acid constructs of the present application, include, but are not limited to the promoters obtained from the *E. coli* lac operon, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (See e.g., Villa-Kamaroff et al., Proc. Natl Acad. Sci. USA 75: 3727-3731 [1978]), as well as the tac promoter (See e.g., DeBoer et al., Proc. Natl Acad. Sci. USA 80: 21-25 [1983]). Exemplary promoters for filamentous fungal host cells, include promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergilius nidulans* acetamidase, and *Fusarium oxysporum* trypsin-like protease (See e.g., WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. Exemplary yeast cell promoters can be from the genes can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphogbyverate kinase. Other useful promoters for yeast host cells are known in the art (See e.g., Romanos et al., Yeast 8:423-488 [1992]).

In some embodiments, the control sequence is a suitable transcription terminator sequence, a sequence recognized by a host cell to terminate transcription. The terminator sequence is operably linked to the 3' terminus of the nucleic acid sequence encoding the polypeptide. Any terminator which is functional in the host cell of choice finds use in the present invention. For example, exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease. Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are known in the art (See e.g., Romanos et al., supra).

In some embodiments, the control sequence is a suitable leader sequence, a non-translated region of an mRNA that is important for translation by the host cell. The leader sequence is operably linked to the 5' terminus of the nucleic acid sequence encoding the polypeptide. Any leader sequence that is functional in the host cell of choice may be used. Exemplary leaders for filamentous fungal host cells are obtained from the genes for *Aspergillus oryzae* TAKA amylase and *Aspergillus nidulans* triose phosphate isomerase. Suitable leaders for yeast host cells include, but are not limited to those obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP). The control sequence may also be a polyadenylation sequence, a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice may be used in the present invention. Exemplary polyadenylation sequences for filamentous fungal host cells include, but are not limited to those from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are also known in the art (See e.g., Guo and Sherman, Mol. Cell. Bio., 15:5983-5990 [1995]).

In some embodiments, the control sequence is a signal peptide coding region that codes for an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence. Any signal peptide coding region that directs the expressed polypeptide into the secretory pathway of a host cell of choice finds use for expression of the engineered β-glucosidase polypeptides provided herein. Effective signal peptide coding regions for bacterial host cells include, but are not limited to the signal peptide coding regions obtained from the genes for *Bacillus* NCIB 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are known in the art (See e.g., Simonen and Palva, Microbiol. Rev., 57:109-137 [1993]). Effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells include, but are not limited to those from the genes for *Saccharomyces cerevisiae* alpha-factor and *Saccharomyces cerevisiae* invertase.

In some embodiments, the control sequence is a propeptide coding region that codes for an amino acid sequence positioned at the amino terminus of a polypeptide. The resultant polypeptide is referred to as a "proenzyme," "propolypeptide," or "zymogen," in some cases). A propolypeptide can be converted to a mature active polypeptide by catalytic or autocatalytic cleavage of the propeptide from the propolypeptide. The propeptide coding region includes, but is not limited to the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (See e.g., WO 95/33836). Where both signal peptide and propeptide regions are present at the amino terminus of a polypeptide, the propeptide region is positioned next to the amino terminus of a polypeptide and the signal peptide region is positioned next to the amino terminus of the propeptide region.

In some embodiments, regulatory sequences are also utilized. These sequences facilitate the regulation of the expression of the polypeptide relative to the growth of the host cell. Examples of regulatory systems are those which cause the expression of the gene to be turned on or off in response to a chemical or physical stimulus, including the presence of a regulatory compound. In prokaryotic host cells, suitable regulatory sequences include, but are not limited to the lac, tac, and trp operator systems. In yeast host cells, suitable regulatory systems include, but are not limited to the ADH2 system or GAL1 system. In filamentous fungi, suitable regulatory sequences include, but are not limited to the TAKA alpha-amylase promoter, *Aspergillus niger* glucoamylase, promoter, and *Aspergillus oryzae* glucoamylase promoter.

The present invention also provides recombinant expression vectors comprising a polynucleotide encoding an engineered β-glucosidase polypeptide, and one or more expression regulating regions such as a promoter and a terminator, a replication origin, etc., depending on the type of hosts into which they are to be introduced. In some embodiments, the various nucleic acid and control sequences described above are combined together to produce a recombinant expression vector which includes one or more convenient restriction sites to allow for insertion or substitution of the nucleic acid sequence encoding the variant β-glucosidase polypeptide at such sites. Alternatively, the polynucleotide sequence(s) of the present invention are expressed by inserting the polynucleotide sequence or a nucleic acid construct comprising the polynucleotide sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus), that can be conveniently subjected to recombinant DNA procedures and can result in the expression of the valiant β-glucosidase polynucleotide sequence. The choice of the vector will typically depend on the compatibility of the vector with the host cell into which the vector is to be introduced. The vectors may be linear or closed circular plasmids.

In some embodiments, the expression vector is an autonomously replicating vector (i.e., a vector that exists as an extra-chromosomal entity, the replication of which is independent of chromosomal replication, such as a plasmid, an extra-chromosomal element, a minichromosome, or an artificial chromosome). The vector may contain any means for assuring self-replication. In some alternative embodiments, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

In some embodiments, the expression vector preferably contains one or more selectable markers, which permit easy selection of transformed cells. A "selectable marker" is a gene the product of which provides for biocide or viral resistance, resistance to heavy metals, prototrophy to auxotrophy, and the like. Examples of bacterial selectable markers include, but are not limited to the dal genes from *Bacillus subtilis* or *Bacillus licheniformis*, or markers, which confer antibiotic resistance such as ampicillin, kanamycin, chloramphenicol or tetracycline resistance. Suitable markers for yeast host cells include, but are not limited to ADE2, HIS3, LEU2, LYS2, MET3, TRP1, and URA3. Selectable markers for use in a filamentous fungal host cell include, but are not limited to, amdS (acetamidase), argB (ornithine carbamoyltransferases), bar (phosphinothricin acetyltransferae), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. In another aspect, the present invention provides a host cell comprising a polynucleotide encoding at least one engineered β-glucosidase polypeptide of the present invention, the polynucleotide being operatively linked to one or more control sequences for expression of the engineered β-glucosidase enzyme(s) in the host cell. Host cells for use in expressing the polypeptides encoded by the expression vectors of the present invention are well known in the art and include but are not limited to, bacterial cells, such as *E. coli, Vibrio fluvialis, Streptomyces* and *Salmonella typhimurium* cells; fungal cells, such as yeast cells (e.g., *Saccharomyces cerevisiae* and *Pichia pastoris* [ATCC Accession No. 201178]); insect cells such as *Drosophila* S2 and *Spodoptera* Sf9 cells; animal cells such as CHO, COS, BHK, 293, and Bowes melanoma cells; and plant cells, Exemplary host cells are *Escherichia coli* strains (e.g., W3110 (ΔfhuA) and BL21).

Accordingly, in another aspect, the present invention provides methods for producing the engineered β-glucosidase polypeptides, where the methods comprise culturing a host cell capable of expressing a polynucleotide encoding the engineered β-glucosidase polypeptide under conditions suitable for expression of the polypeptide. In some embodiments, the methods further comprise the steps of isolating and/or purifying the β-glucosidase polypeptides, as described herein.

Appropriate culture media and growth conditions for the above-described host cells are well known in the art. Polynucleotides for expression of the β-glucosidase polypeptides may be introduced into cells by various methods known in the art. Techniques include, among others, electroporation, biolistic particle bombardment, liposome mediated transfection, calcium chloride transfection, and protoplast fusion.

The engineered β-glucosidases with the properties disclosed herein can be obtained by subjecting the polynucleotide encoding the naturally occurring or engineered β-glucosidase polypeptide to mutagenesis and/or directed evolution methods known in the art, and as described herein. An exemplary directed evolution technique is mutagenesis and/or DNA shuffling (See e.g., Stemmer, Proc. Natl. Acad. Sci. USA 91:1074740751 [1994]; WO 95/22625; WO 97/0078; WO 97/35966; WO 98/27230; WO 00/42651; WO 01/75767 and U.S. Pat. No. 6,537,746). Other directed evolution procedures that can be used include, among others, staggered extension process (StEP), in vitro recombination (See e.g., Zhao et al., Nat. Biotechnol. 16:258-261 [1998]), mutagenic PCR (See e.g., Caldwell et al., PCR Methods Appl., 3:S136-S140 [1994]), and cassette mutagenesis (See e.g., Black et al., Proc. Natl. Acad. Sci. USA 93:3525-3529 [1996]).

For example, mutagenesis and directed evolution methods can be readily applied to polynucleotides to generate variant libraries that can be expressed, screened, and assayed. Mutagenesis and directed evolution methods are well known in the art (See e.g., U.S. Pat. Nos. 5,605,793, 5,830,721, 6,132,970, 6,420,175, 6,277,638, 6,365,408, 6,602,986, 7,288,375, 6,287,861, 6,297,053, 6,576,467, 6,444,468, 5,811,238, 6,117,679, 6,165,793, 6,180,406, 6,291,242, 6,995,017, 6,395,547, 6,506,602, 6,519,065, 6,506,603, 6,413,774, 6,573,098, 6,323,030, 6,344,356, 6,372,497, 7,868,138, 5,834,252, 5,928,905, 6,489,146, 6,096,548, 6,387,702, 6,391,552, 6,358,742, 6,482,647, 6,335,160, 6,653,072, 6,355,484, 6,303,344, 6,319,713, 6,613,514, 6,455,253, 6,579,678, 6,586,182, 6,406,855, 6,946,296, 7,534,564, 7,776,598, 5,837,458, 6,391,640, 6,309,883, 7,105,297, 7,795,030, 6,326,204, 6,251,674, 6,716,631, 6,528,311, 6,287,862, 6,335,198, 6,352,859, 6,379,964, 7,148,054, 7,629,170, 7,620,500, 6,365,377, 6,358,740, 6,406,910, 6,413,745, 6,436,675, 6,961,664, 6,537,746, 7,430,477, 7,873,499, 7,702,464, 7,783,428, 7,747,391, 7,747,393, 7,751,986, 6,376,246, 6,426,224, 6,423,542, 6,479,652, 6,319,714, 6,521,453, 6,368,861, 7,421,347, 7,058,515, 7,024,312, 7,620,502, 7,853410, 7,957,912, 7,904,249, 8,383,346, 8,504,498, 8,768,871, 8,762,066, 8,849,575, and all related non-US counterparts; Ling et al., Anal. Biochem., 254:157-78 [1997]; Dale et al., Meth. Mol. Biol., 57:369-74 [1996]; Smith, Ann. Rev. Genet., 19:423-462 [1985]; Botstein et al., Science, 229:1193-1201 [1985]; Carter, Biochem. J., 237:1-7 [1986]; Kramer et al., Cell, 38:879-887 [1984]; Wells et al., Gene, 34:315-323 [1985]; Minshull et al., Curr. Op. Chem. Biol., 3:284-290 [1999]; Christians et al., Nat. Biotechnol., 17:259-264 [1999]; Crameri et al., Nature, 391:288-291 [1998]; Crameri, et al., Nat. Biotechnol., 15:436-438 [1997]; Zhang et al., Proc. Nat. Acad. Sci. U.S.A., 94:4504-4509 [1997]; Crameri et al., Nat. Biotechnol., 14:315-319 [1996]; Stemmer, Nature, 370:389-391 [1994]; Stemmer, Proc. Nat. Acad. Sci. USA, 91:10747-10751 [1994]; WO 95/22625; WO 97/0078; WO 97/35966; WO 98/27230; WO 00/42651; WO 01/75767; WO 2009/152336, WO 2009/102901, WO 2009/102899, WO 2011/035105, WO 2013/138339, WO 2013/003290, WO 2014/120819, WO 2014/120821, WO 2015/0134315, and WO 2015/048573, all of which are incorporated herein by reference).

In some embodiments, the enzyme clones obtained following mutagenesis treatment are screened by subjecting the enzymes to a defined temperature (or other assay conditions, such as testing the enzyme's activity over a broad range of substrates) and measuring the amount of enzyme activity remaining after heat treatments or other assay conditions. Clones containing a polynucleotide encoding a β-glucosidase polypeptide are then sequenced to identify the nucleotide sequence changes (if any), and used to express the enzyme in a host cell. Measuring enzyme activity from the expression libraries can be performed using any suitable method known in the art (e.g., standard biochemistry techniques, such as HPLC analysis).

In some embodiments, the clones obtained following mutagenesis treatment can be screened for engineered β-glucosidases having one or more desired improved enzyme properties (e.g., improved regioselectivity. Measuring enzyme activity from the expression libraries can be performed using the standard biochemistry techniques, such as HPLC analysis and/or derivatization of products (pre or post separation), for example, using dansyl chloride or OPA (See e.g., Yaegaki et al., J Chromatogr. 356(1): 163-70 [1986]).

When the sequence of the engineered polypeptide is known, the polynucleotides encoding the enzyme can be prepared by standard solid-phase methods, according to known synthetic methods. In some embodiments, fragments of up to about 100 bases can be individually synthesized, then joined (e.g., by enzymatic or chemical ligation methods, or polymerase mediated methods) to form any desired continuous sequence. For example, polynucleotides and oligonucleotides encoding portions of the β-glucosidase can be prepared by chemical synthesis as known in the art (e.g., the classical phosphoramidite method of Beaucage et al., Tet. Lett. 22:1859-69 [1981], or the method described by Matthes et al., EMBO J. 3:801-05 [1984]) as typically practiced in automated synthetic methods. According to the phosphoramidite method, oligonucleotides are synthesized (e.g., in an automatic DNA synthesizer), purified, annealed, ligated and cloned in appropriate vectors. In addition, essentially any nucleic acid can be obtained from any of a variety of commercial sources. In some embodiments, additional variations can be created by synthesizing oligonucleotides containing deletions, insertions, and/or substitutions, and combining the oligonucleotides in various permutations to create engineered β-glucosidases with improved properties.

Accordingly, in some embodiments, a method for preparing the engineered β-glucosidases polypeptide comprises: (a) synthesizing a polynucleotide encoding a polypeptide comprising an amino acid sequence having at least about 80%, 85%, 86%, 87%, 88%, 89%, 90%, 91%, 92%, 93%, 94%, 95%, 96%, 97%, 98%, or 99% or more sequence identity to an amino acid sequence selected from the even-numbered sequences of SEQ ID NOS:22-294, and having one or more residue differences as compared to SEQ ID NO:12 at residue positions selected from: 31, 32, 34, 36, 37, 38, 57/91, 58, 59, 60, 61, 62, 62/403, 66, 70, 89, 89/187, 91/595, 124/297, 125, 126/188, 133, 138/296, 147, 150, 184, 186, 187, 230, 231, 233, 266, 296, 297, 403, 405, 449, 450, 492, 590, and 601; and (b) expressing the β-glucosidase polypeptide encoded by the polynucleotide.

Accordingly, in some embodiments, a method for preparing the engineered β-glucosidases polypeptide comprises: (a) synthesizing a polynucleotide encoding a polypeptide comprising an amino acid sequence having at least about 80%, 85%, 86%, 87%, 88%, 89%, 90%, 91%, 92%, 93%, 94%, 95%, 96%, 97%, 98%, or 99% or more sequence identity to an amino acid sequence selected from the even-numbered sequences of SEQ ID NOS:22-294, and having one or more residue differences as compared to SEQ ID NO:12, selected from: 31C/G, V32G/P/S, 34I/P, 36P, 37K/W, 38E, 57R/91P, 58P, 59R, 60C/V, 61R, 62N, 62P/403R, 66G/N, 70W, 89L, 89S/187R, 91G/595V, 124D/297P, 125G, 126V/188R, 133G/R, 138G/296S, 147L, 150H/L/M/P/T, 184A/R, 186E, 187G/N/Y, 230F/H/I, 231G/R, 233L/P/Q, 266F/G, 296R/T, 297R, 403E/P, 405R, 449G/P, 450G, 492P, 590W, 601A/E/L, 601E, and 601L; and (b) expressing the β-glucosidase polypeptide encoded by the polynucleotide.

Accordingly, in some embodiments, a method for preparing the engineered β-glucosidases polypeptide comprises: (a) synthesizing a polynucleotide encoding a polypeptide comprising an amino acid sequence having at least about 80%, 85%, 86%, 87%, 88%, 89%, 90%, 91%, 92%, 93%, 94%, 95%, 96%, 97%, 98%, or 99% or more sequence identity to an amino acid sequence selected from the even-numbered sequences of SEQ ID NOS:22-294, and having one or more residue differences as compared to SEQ ID NO:12, selected from: P31C/G, V32G/P/S, G34I/P, I36P, T37K/W, T38E, G57R/I91P, L58P, F59R, N60C/R/V, L61R, K62N, K62P/W403R, R66G/N, V70W, D89L, D89S/H187R, I91G/G595V, A124D/V297P, S125G, A126V/F188R, F133G/R, D138G/M296S, R147L, E150H/L/M/P/T, C184A/R, K186E, H187G/N/Y, M230F/H/I, A231G/R, F233L/P/Q, Y266F/G, M296R/T, V297R, W403E/P, V405R, M449G/P, F450G, S492P, R590W, and F601A/E/L; and (b) expressing the β-glucosidase polypeptide encoded by the polynucleotide.

Accordingly, in some embodiments, a method for preparing the engineered β-glucosidases polypeptide comprises: (a) synthesizing a polynucleotide encoding a polypeptide comprising an amino acid sequence having at least about 80%, 85%, 86%, 87%, 88%, 89%, 90%, 91%, 92%, 93%, 94%, 95%, 96%, 97%, 98%, or 99% or more sequence identity to an amino acid sequence selected from the even-numbered sequences of SEQ ID NOS:22-294, and having one or more residue differences as compared to SEQ ID NO:12 at residue positions selected from: 32, 34, 36, 57/91, 58, 59, 60, 62, 62/403, 66, 89, 89/187, 91/595, 124/297, 126/188, 133, 138/296, 147, 150, 184, 186, 187, 230, 231, 233, 266, 296, 297, 403, 405, 449, 492, 590, and 601; and (b) expressing the β-glucosidase polypeptide encoded by the polynucleotide.

Accordingly, in some embodiments, a method for preparing the engineered β-glucosidases polypeptide comprises: (a) synthesizing a polynucleotide encoding a polypeptide comprising an amino acid sequence having at least about 80%, 85%, 86%, 87%, 88%, 89%, 90%, 91%, 92%, 93%, 94%, 95%. 96%, 97%, 98%, or 99% or more sequence identity to an amino acid sequence selected from the even-numbered sequences of SEQ ID NOS:22-294, and having one or more residue differences as compared to SEQ ID NO:12, selected from: 32G/P/S, 34I/P, 36P, 57R/91P, 58P, 59R, 60C/R/V, 62N, 62P/403R, 66N, 89L, 89S/187R, 91G/595V, 124D/297P, 126V/188R, 133G/R, 138G/,296S, 147L, 150H/L/M/P/T, 184R, 186E, 187G, 187N/Y, 230F/H/I, 231G/R, 233P/Q, 266F/G, 296R/T, 297R, 403E/P, 405R, M449G/P, 492P, 590W, and 601A/E/L; and (b) expressing the β-glucosidase polypeptide encoded by the polynucleotide.

Accordingly, in some embodiments, a method for preparing the engineered β-glucosidases polypeptide comprises: (a) synthesizing a polynucleotide encoding a polypeptide comprising an amino acid sequence having at least about 80%, 85%, 86%, 87%, 88%, 89%, 90%, 91%, 92%, 93%, 94%, 95%, 96%, 97%, 98%, or 99% or more sequence identity to an amino acid sequence selected from the even-numbered sequences of SEQ ID NOS:22-294, and having one or more residue differences as compared to SEQ ID NO:12, selected from: V32G/P/S, G34I/P, I36P, G57R/I91P, L58P, F59R, N60C/R/V, K62N, K62P/W403R, R66N, D89L, D89S/H187R, I91G/G595V, A124D/V297P, A126V/F188R, F133G/R, D138G/M296S, R147L, E150H/L/M/P/T, C184R, K186E, H187G/N/Y, M230F/H/I, A231G/R, F233P/Q, Y266F/G, M296R/T, V297R, W403E/P, V405R, M449G/P, S492P, R590W, and F601A/E/L; and (b) expressing the β-glucosidase polypeptide encoded by the polynucleotide.

Accordingly, in some embodiments, a method for preparing the engineered β-glucosidases polypeptide comprises: (a) synthesizing a polynucleotide encoding a polypeptide comprising an amino acid sequence having at least about 80%, 85%, 86%, 87%, 88%, 89%, 90%, 91%, 92%, 93%, 94%, 95%, 96%, 97%, 98%, or 99% or more sequence identity to an amino acid sequence selected from the even-numbered sequences of SEQ ID NOS:174-294, and having one or more residue differences as compared to SEQ ID NO:14 at residue positions selected from: 15, 16, 16/84, 17, 19, 21, 35, 45, 55, 76, 79, 121, 164, 168, 168/256, 170, 179, 215/413, 221, 221/311, 225, 247, 313, 351, 356, 402, 404, 405, 409, 411, 412, 413, and 414; and (b) expressing the β-glucosidase polypeptide encoded by the polynucleotide.

Accordingly, in some embodiments, a method for preparing the engineered β-glucosidases polypeptide comprises: (a) synthesizing a polynucleotide encoding a polypeptide comprising an amino acid sequence having at least about 80%, 85%, 86%, 87%, 88%, 89%, 90%, 91%, 92%, 93%, 94%, 95%, 96%, 97%, 98%, or 99% or more sequence identity to an amino acid sequence selected from the even-numbered sequences of SEQ ID NOS:174-294, and having one or more residue differences as compared to SEQ ID NO:14, selected from: 15S, 16A/G, 16S/84H, 17G, 19G, 21A/E/F/G/H/S, 35A/G, 45L, 55P, 76G/L, 76L, 79T, 121S, 164Y, 168E/G/K/L/S, 168Q/256V, 170H, 179H/R, 215S/413P, 221C/G/T, 221P/311V, 225H/N/Y, V247G/I/L, 313V, 351A/L, 356, 402K, 404P/S, 405H/W, 409T, 411A/D/G/R/T, 412L, 413A/H/P, and 414D; and (b) expressing the β-glucosidase polypeptide encoded by the polynucleotide.

Accordingly, in some embodiments, a method for preparing the engineered β-glucosidases polypeptide comprises: (a) synthesizing a polynucleotide encoding a polypeptide comprising an amino acid sequence having at least about 80%, 85%, 86%, 87%, 88%, 89%, 90%, 91%, 92%, 93%, 94%, 95%, 96%, 97%, 98%, or 99% or more sequence identity to an amino acid sequence selected from the even-numbered sequences of SEQ ID NOS:174-294, and having one or more residue differences as compared to SEQ ID NO:14, selected from: A15S, T16A/G, T16S/R84H, A17G, Y19G, I21A/E/F/G/H/S, W35A/G, I145L, C55P, Y76G/L, S79T, H121S, L164Y, W168E/G/K/L/S, W168Q/A256V, S170H, V179H/R, P215S/M413P, V221C/G/T, V221P/A311V, T225H/N/Y, V247G/I/L, R313V, T351A/L, A356G, L402K, N404P/S, F405H/W, M409T, L411A/D/G/R/T, S412L, M413A/H, M413P, and R414D; and (h) expressing the β-glucosidase polypeptide encoded by the polynucleotide.

In some embodiments of the method, the polynucleotide encodes an engineered β-glucosidase that has optionally one or several (e.g., up to 3, 4, 5, or up to 10) amino acid residue deletions, insertions and/or substitutions. In some embodiments, the amino acid sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions can be conservative or non-conservative substitutions.

In some embodiments, any of the engineered β-glucosidase enzymes expressed in a host cell can be recovered from the cells and/or the culture medium using any one or more of the well-known techniques for protein purification, including, among others, lysozyme treatment, sonication, filtration, salting-out, ultra-centrifugation, and chromatography. Suitable solutions for lysing and the high efficiency extraction of proteins from bacteria, such as *E. coli*, are commercially available (e.g., CelLytic B™, Sigma-Aldrich, St. Louis Mo.).

Chromatographic techniques for isolation of the β-glucosidase polypeptide include, among others, reverse phase chromatography high performance liquid chromatography, ion exchange chromatography, gel electrophoresis, and affinity chromatography. Conditions for purifying a particular enzyme will depend, in part, on factors such as net charge, hydrophobicity, hydrophilicity, molecular weight, molecular shape, etc., and will be apparent to those having skill in the art.

In some embodiments, affinity techniques may be used to isolate the improved β-glucosidase enzymes. For affinity chromatography purification, any antibody which specifically binds the β-glucosidase polypeptide may be used. For the production of antibodies, various host animals, including but not limited to rabbits, mice, rats, etc., may be immunized by injection with a β-glucosidase polypeptide, or a fragment thereof. The β-glucosidase polypeptide or fragment may be attached to a suitable carrier, such as BSA, by means of a side chain functional group or linkers attached to a side chain functional group. In some embodiments, the affinity purification can use a specific ligand bound by the β-glucosidase or dye affinity column (See e.g., EP0641862; Stellwagen, "Dye Affinity Chromatography," In *Current Protocols in Protein Science*, Unit 9.2-9.2.16 [2001]).

Methods of Using the Engineered β-Glucosidase Enzymes

In some embodiments, the β-glucosidases described herein find use in processes for converting a suitable substrate to its β-glucosylated product. Generally, the process for performing the transglucosylation reaction comprises contacting or incubating the substrate compound in presence of a glycosyl donor co-substrate, such as a β-linked disaccharide, trisaccharide, or oligosaccharide or mixture thereof, for example cellobiose, gentiobiose, laminaribiose, sophorose, β,β-trehalose, cellotriose, cellulose, etc., with a β-glucosidase polypeptide of the invention under reaction conditions suitable for formation of the β-glucosylated product, as shown in FIG. 1.

In the embodiments provided herein and illustrated in the Examples, various ranges of suitable reaction conditions that can be used in the processes, include but are not limited to, substrate loading, co-substrate loading, pH, temperature, buffer, solvent system, polypeptide loading, and reaction time. Further suitable reaction conditions for carrying out the process for biocatalytic conversion of substrate compounds to product compounds using an engineered β-glucosidases described herein can be readily optimized in view of the guidance provided herein by routine experimentation that includes, but is not limited to, contacting the engineered β-glucosidase polypeptide and substrate compound under experimental reaction conditions of concentration, pH, temperature, and solvent conditions, and detecting the product compound.

Suitable reaction conditions using the engineered β-glucosidasepolypeptides typically comprise a co-substrate, which is used stoichiometrically in the hydroxylation reaction. Generally, the co-substrate for β-glucosidases in a transglucosylation reaction is β-linked disaccharide, trisaccharide, or oligosaccharide or mixture thereof, for example cellobiose, gentiobiose, laminaribiose, sophorose, β,β-trehalose, cellotriose, cellulose, etc., and may be a mixture of glucose donor co-substrates derived from biomass. Because a disaccharide co-substrate is used stoichiotnetrically, the co-substrate is present at an equimolar or higher amount than that of the substrate compound (i.e., the molar concentration of co-substrate is equivalent to or higher than the molar concentration of substrate compound). In some embodiments, the suitable reaction conditions can comprise a disaccharide co-substrate molar concentration of at least 1 fold, 1.5 fold, 2 fold, 3 fold 4 fold or 5 fold or more than the molar concentration of the substrate compound. In some embodiments, the suitable reaction conditions can comprise a co-substrate concentration, particularly cellobiose, of about 0.001 M to about 0.35 M, 0.01 M to about 0.35 M, 0.1 M to about 0.35 M, or 0.2 M to about 0.35 M. In some embodiments, the reaction conditions comprise a co-substrate concentration of about 0.001, 0.01, 0.1, 0.2, 0.3, 0.4M. In some embodiments, additional co-substrate can be added during the reaction.

The substrate compound(s) in the reaction mixtures can be varied, taking into consideration, for example, the desired amount of product compound, the effect of substrate concentration on enzyme activity, stability of enzyme under reaction conditions, and the percent conversion of substrate to product. In some embodiments, the suitable reaction conditions comprise a substrate compound loading of at least about 0.5 to about 25 g/L, 1 to about 25 g/L, 5 to about 25 g/L, about 10 to about 25 g/L, or 20 to about 25 g/L. In some embodiments, the suitable reaction conditions comprise a substrate compound loading of at least about 0.5 g/L, at least about 1 g/L, at least about 5 g/L, at least about 10 g/L, at least about 15 g/L, at least about 20 g/L, or at least about 30 g/L, or even greater. The values for substrate loadings provided herein are based on the molecular weight of rebaudioside D, however it also contemplated that the equivalent molar amounts of various hydrates and salts of rebaudioside D, rebaudioside A, stevioside, or other substrates also can be used in the process.

In carrying out the β-glucosidase mediated processes described herein, the engineered polypeptide may be added to the reaction mixture in the form of a purified enzyme, partially purified enzyme, whole cells transformed with gene(s) encoding the enzyme, as cell extracts and/or lysates of such cells, and/or as an enzyme immobilized on a solid support. Whole cells transformed with gene(s) encoding the engineered β-glucosidase enzyme or cell extracts, lysates thereof, and isolated enzymes may be employed in a variety of different forms, including solid (e.g., lyophilized, spray-dried, and the like) or semisolid (e.g., a crude paste). The cell extracts or cell lysates may be partially purified by precipitation (ammonium sulfate, polyethyleneimine, heat treatment or the like, followed by a desalting procedure prior to lyophilization ultrafiltration, dialysis, etc.). Any of the enzyme preparations (including whole cell preparations) may be stabilized by crosslinking using known crosslinking agents, such as, for example, glutaraldehyde or immobilization to a solid phase (e.g., Eupergit C, and the like).

The gene(s) encoding the engineered β-glucosidase polypeptides can be transformed into host cell separately or together into the same host cell. For example, in some embodiments one set of host cells can be transformed with gene(s) encoding one engineered β-glucosidase polypeptide and another set can be transformed with gene(s) encoding another engineered β-glucosidase polypeptide. Both sets of transformed cells can be utilized together in the reaction mixture in the form of whole cells, or in the form of lysates or extracts derived therefrom. In other embodiments, a host cell can be transformed with gene(s) encoding multiple engineered β-glucosidase polypeptide. In some embodiments the engineered polypeptides can be expressed in the form of secreted polypeptides and the culture medium containing the secreted polypeptides can be used for the β-glucosidase reaction.

In some embodiments, the improved activity and/or regioselectivity and/or stereoselectivity of the engineered β-glucosidase polypeptides disclosed herein provides for processes wherein higher percentage conversion can be achieved with lower concentrations of the engineered polypeptide. In some embodiments of the process, the suitable reaction conditions comprise an engineered polypeptide amount of about 1% (w/w), 2% (w/w), 5% (w/w), 10% (w/w), 20% (w/w), 30% (w/w), 40% (w/w), 50% (w/w), 75% (w/w), 100% (w/w) or more of substrate compound loading.

In some embodiments, the engineered polypeptide is present at about 0.01 g/L to about 50 g/L; about 0.05 g/L to about 50 g/L; about 0.1 g/L to about 40 g/L; about 1 g/L to about 40 g/L; about 2 g/L to about 40 g/L; about 5 g/L to about 40 g/L; about 5 g/L to about 30 g/L; about 0.1 g/L to about 10 g/L; about 0.5 g/L to about 10 g/L; about 1 g/L to about 10 g/L; about 0.1 g/L to about 5 g/L; about 0.5 g/L to about 5 g/L; or about 0.1 g/L to about 2 g/L. In some embodiments, the β-glucosidase polypeptide is present at about 0.01 g/L, 0.05 g/L, 0.1 g/L, 0.2 g/L, 0.5 g/L, 1, 2 g/L, 5 g/L, 10 g/L, 15 g/L, 20 g/L, 25 g/L, 30 g/L, 35 g/L, 40 g/L, or 50 g/L.

During the course of the reaction, the pH of the reaction mixture may change. The pH of the reaction mixture may be maintained at a desired PH or within a desired pH range. This may be done by the addition of an acid or a base, before and/or during the course of the reaction. Alternatively, the pH may be controlled by using a buffer. Accordingly, in some embodiments, the reaction condition comprises a buffer. Suitable buffers to maintain desired pH ranges are known in the art and include, by way of example and not limitation, borate, phosphate, 2-(N-morpholino)ethanesulfonic acid (MES), 3-(N-morpholino propanesulfonic acid (MOPS), acetate, triethanolamine, and 2-amino-2-hydroxymethyl-propane-1,3-diol (Tris), and the like. In some embodiments, the buffer is acetate. In some embodiments of the process, the suitable reaction conditions comprise a buffer acetate) concentration of from about 0.01 to about 0.4 M, 0.05 to about 0.4 M, 0.1 to about 0.3 M, or about 0.1 to about 0.2 M. In some embodiments, the reaction condition comprises a buffer (e.g., acetate) concentration of about 0.01, 0.02, 0.03, 0.04, 0.05, 0.07, 0.1, 0.12, 0.14, 0.16, 0.18, 0.2, 0.3, or 0.4 M. In some embodiments, the reaction conditions comprise water as a suitable solvent with no buffer present.

In the embodiments of the process, the reaction conditions comprise a suitable pH. The desired pH or desired pH range can be maintained by use of an acid or base, an appropriate buffer, or a combination of buffering and acid or base addition. The pH of the reaction mixture can be controlled before and/or during the course of the reaction. In some embodiments, the suitable reaction conditions comprise a solution pH from about 4 to about 10, pH from about 5 to about 10, pH from about 5 to about 9, pH from about 6 to about 9, pH from about 6 to about 8. In some embodiments, the reaction conditions comprise a solution pH of about 4, 4.5, 5, 5.5, 6, 6.5, 7, 7.5, 8, 8.5, 9, 9.5, or 10.

In the embodiments of the processes herein, a suitable temperature is used for the reaction conditions, for example, taking into consideration the increase in reaction rate at higher temperatures, and the activity of the enzyme during the reaction time period. Accordingly, in some embodiments, the suitable reaction conditions comprise a temperature of about 10° C. to about 60° C., about 10° C. to about 55° C., about 15° C. to about 60° C., about 20° C. to about 60° C., about 20° C. to about 55° C., about 25° C. to about 55° C., or about 30° C. to about 50° C. In some embodiments, the suitable reaction conditions comprise a temperature of about 10° C., 15° C., 20° C., 25° C., 30° C., 35° C., 40° C., 45° C., 50° C., 55° C., or 60° C. In some embodiments, the temperature during the enzymatic reaction can be maintained at a specific temperature throughout the course of the reaction. In some embodiments, the temperature during the enzymatic reaction can be adjusted over a temperature profile during the course of the reaction.

The processes of the invention are generally carried out in a solvent. Suitable solvents include water, aqueous buffer solutions, organic solvents, polymeric solvents, and/or co-solvent systems, which generally comprise aqueous solvents, organic solvents and/or polymeric solvents. The aqueous solvent (water or aqueous co-solvent system) may be pH-buffered or unbuffered. In some embodiments, the processes using the engineered β-glucosidase polypeptides can be carried out in an aqueous co-solvent system comprising an organic solvent (e.g., ethanol, isopropanol (IPA), dimethyl sulfoxide (DMSO), dimethylformamide (DMF) ethyl acetate, butyl acetate, 1-octanol, heptane, octane, methyl t butyl ether (MTBE), toluene, and the like), ionic or polar solvents (e.g., 1-ethyl 4 methylimidazolium tetrafluoroborate, 1-butyl-3-methylitnidazolium tetrafluoroborate, 1-butyl 3 methylimidazolium hexafluorophosphate, glycerol, polyethylene glycol, and the like). In some embodiments, the co-solvent can be a polar solvent, such as a polyol, dimethylsulfoxide (DMSO), or lower alcohol. The non-aqueous co-solvent component of an aqueous co-solvent system may be miscible with the aqueous component, providing a single liquid phase, or may be partly miscible or immiscible with the aqueous component, providing two liquid phases. Exemplary aqueous co-solvent systems can comprise water and one or more co-solvents selected from an organic solvent, polar solvent, and polyol solvent. In general, the co-solvent component of an aqueous co-solvent system is chosen such that it does not adversely inactivate the β-glucosidase enzyme under the reaction conditions. Appropriate co-solvent systems can be readily identified by measuring the enzymatic activity of the specified engineered β-glucosidase enzyme with a defined substrate of interest in the candidate solvent system, utilizing an enzyme activity assay, such as those described herein.

In some embodiments of the process, the suitable reaction conditions comprise an aqueous co-solvent, where the co-solvent comprises ethanol at about 1% to about 50% (v/v), about 1 to about 40% (v/v), about 2% to about 40% (v/v), about 5% to about 30% (v/v), about 10% to about 30% (v/v), or about 10% to about 20% (v/v). In some embodiments of the process, the suitable reaction conditions can comprise an aqueous co-solvent comprising ethanol at about 1% (v/v), about 5% (v/v), about 10% (v/v), about 15% (v/v), about 20% (v/v), about 25% (v/v), about 30% (v/v), about 35% (v/v), about 40% (v/v), about 45% (v/v), or about 50% (v/v).

In some embodiments, the reaction conditions comprise a surfactant for stabilizing or enhancing the reaction. Surfactants can comprise non-ionic, cationic, anionic and/or amphiphilic surfactants. Exemplary surfactants, include by way of example and not limitation, nonyl phenoxypolyethoxylethanol (NP40), TRITON™ X-100 polyethylene glycol Pert-octylphenyl ether, polyoxyethylene-stearylamine, cetyltrimethylammonium bromide, sodium oleylamidosulfate, polyoxyethylene-sorbitanmonosteamte, hexadecyldimetlyylamine, etc. Any surfactant that may stabilize or enhance the reaction may be employed. The concentration of the surfactant to be employed in the reaction may be generally from 0.1 to 50 mg/ml, particularly from 1 to 20 mg/ml.

In some embodiments, the reaction conditions include an antifoam agent, which aids in reducing or preventing formation of foam in the reaction solution, such as when the reaction solutions are mixed or sparged. Anti-foam agents include non-polar oils (e.g., minerals, silicones, etc.), polar oils (e.g., fatty acids, alkyl amines, alkyl amides, alkyl sulfates, etc.), and hydrophobic (e.g., treated silica, polypropylene, etc.), some of which also function as surfactants, Exemplary anti-foam agents include, Y-30® (Dow Corning), poly-glycol copolymers, oxy/ethoxylated alcohols, and polydimethylsiloxanes. In some embodiments, the anti-foam can be present at about 0.001% (v/v) to about 5% (v/v), about 0.01% (v/v) to about 5% (v/v), about 0.1% (v/v) to about 5% (v/v), or about 0.1% (v/v) to about 2% (v/v). In some embodiments, the anti-foam agent can be present at about 0.001% (v/v), about 0.01% (v/v), about 0.1% (v/v), about 0.5% (v/v), about 1% (v/v), about 2% (v/v), about 3% (v/v), about 4% (v/v), or about 5% (v/v) or more as desirable to promote the reaction.

The quantities of reactants used in the transglycosylation reaction will generally vary depending on the quantities of product desired, and concomitantly the amount of β-glucosidase substrate employed. Those having ordinary skill in the art will readily understand how to vary these quantities to tailor them to the desired level of productivity and scale of production.

In some embodiments, the order of addition of reactants is not critical. The reactants may be added together at the same time to a solvent (e.g., monophasic solvent, biphasic aqueous co-solvent system, and the like), or alternatively, some of the reactants may be added separately, and some together at different time points. For example, the cofactor, co-substrate, β-glucosidase, and substrate may be added first to the solvent.

The solid reactants (e.g., enzyme, salts, etc.) may be provided to the reaction in a variety of different forms, including powder (e.g., lyophilized, spray dried, and the like), solution, emulsion, suspension, and the like. The reactants can be readily lyophilized or spray dried using methods and equipment that are known to those having ordinary skill in the art. For example, the protein solution can be frozen at −80° C. in small aliquots, then added to a pre-chilled lyophilization chamber, followed by the application of a vacuum.

For improved mixing efficiency when an aqueous cosolvent system is used, the β-glucosidase, and co-substrate may be added and mixed into the aqueous phase first. The β-glucosidase substrate may be added and mixed in, followed by the organic phase or the substrate may be dissolved in the organic phase and mixed in. Alternatively, the β-glucosidase substrate may be premixed in the organic phase, prior to addition to the aqueous phase.

The transglycosylation process is generally allowed to proceed until further conversion of substrate to glycosylated product does not change significantly with reaction time (e.g., less than 10% of substrate being converted, or less than 5% of substrate being converted). In some embodiments, the reaction is allowed to proceed until there is complete or near complete conversion of substrate to product. Transformation of substrate to product can be monitored using known methods by detecting substrate and/or product, with or without derivatization. Suitable analytical methods include gas chromatography, HPLC, MS, and the like.

In some embodiments of the process, the suitable reaction conditions comprise a substrate loading of at least about 5 g/L, 10 g/L, 20 g/L, or more, and wherein the method results in at least about 50%, 60%, 70%, 80%, 90%, 95% or greater conversion of substrate compound to product compound in about in about 24 h or less, in about 12 h or less, in about 6 h or less, or in about 4 h or less.

The engineered β-glucosidase polypeptides of the present invention when used in the process under suitable reaction conditions result in an excess of the β-glucosylated product in at least 90%, 95%, 96%, 97%, 98%, 99%, or greater diastereomeric excess over the α-glucosylated product. In some embodiments, no detectable amount of compound α-glucosylated product is formed.

In further embodiments of the processes for converting substrate compound to glucosylated product compound using the engineered β-glucosidase polypeptides, the suitable reaction conditions can comprise an initial substrate loading to the reaction solution which is then contacted by the polypeptide. This reaction solution is then further supplemented with additional substrate compound as a continuous or batchwise addition over time at a rate of at least about 1 g/L/h, at least about 2 g/L/h, at least about 4 g/L/h, at least about 6 g/L/h, or higher. Thus, according to these suitable reaction conditions, polypeptide is added to a solution having an initial substrate loading of at least about 1 g/L, 5 g/L, or 10 g/L. This addition of polypeptide is then followed by continuous addition of further substrate to the solution at a rate of about 2 g/L/h, 4 g/L/h, or 6 g/L/h until a much higher final substrate loading of at least about 30 g/L or more, is reached. Accordingly, in some embodiments of the process, the suitable reaction conditions comprise addition of the polypeptide to a solution having an initial substrate loading of at least about 1 g/L, 5 g/L, or 10 g/L followed by addition of further substrate to the solution at a rate of about 2 g/L/h, 4 g/L/h, or 6 g/L/h until a final substrate loading of at least about 30 g/L or more, is reached. This substrate supplementation reaction condition allows for higher substrate loadings to be achieved while maintaining high rates of conversion of substrate to glucosylated product of at least about 5%, 25%, 50%, 75%, 90% or greater conversion of substrate. In some embodiments of this process, the substrate added is in a solution comprising cellobiose at an equimolar or higher amount of the further added substrate.

In some embodiments of the processes, the reaction using an engineered β-glucosidase polypeptide comprises the following suitable reaction conditions: (a) substrate loading at about 1 g/L to 30 g/L; (b) about 1 g/L to about 50 g/L of engineered polypeptide; (c) cellobiose at about 150 to 300 molar equivalents of substrate compound; (d) pH of about 4.5 to 6.5; (e) temperature of about 30° to 60° C.; and (f) reaction time of 1 to 18 h.

In some embodiments, additional reaction components or additional techniques carried out to supplement the reaction conditions. These can include taking measures to stabilize or prevent inactivation of the enzyme, reduce product inhibition, shift reaction equilibrium to glucosylated product formation.

In further embodiments, any of the above described process for the conversion of substrate compound to product compound can further comprise one or more steps selected from: extraction; isolation; purification; and crystallization of product compound. Methods, techniques, and protocols for extracting, isolating, purifying, and/or crystallizing the glucosylated product from biocatalytic reaction mixtures produced by the above disclosed processes are known to the ordinary artisan and/or accessed through routine experimentation. Additionally, illustrative methods are provided in the Examples below.

Various features and embodiments of the invention are illustrated in the following representative examples, which are intended to be illustrative, and not limiting.

EXPERIMENTAL

The following Examples, including experiments and results achieved, are provided for illustrative purposes only and are not to be construed as limiting the present invention.

In the experimental disclosure below, the following abbreviations apply: M (molar); mM (millimolar), uM and μM (micromolar); nM (nanomolar); mol (moles); gm and g (gram); mg (milligrams); ug and μg (micrograms); L and l (liter); ml and mL (milliliter); cm (centimeters); mm (millimeters); um and μm (micrometers); sec. (seconds); min(s) (minute(s)); h(s) and hr(s) (hour(s)); U (units); MW (molecular weight); rpm (rotations per minute); psi and PSI (pounds per square inch); ° C., (degrees Centigrade); RT and rt (room temperature); CV (coefficient of variability); CAM and cam (chloramphenicol); PMBS (polymyxin B sulfate); IPTG (isopropyl β-D-1-thiogalactopyranoside); LB (Luria broth); TB (terrific broth); SFP (shake flask powder); CDS (coding sequence); DNA (deoxyribonucleic acid); RNA (ribonucleic acid); E. coli W3110 (commonly used laboratory E. coli strain, available from the Coli Genetic Stock Center [CGSC], New Haven, Conn.); GH1 (glycoside hydrolase family 1); GH3 (glycoside hydrolase family 3); HTP (high throughput); HPLC (high pressure liquid chromatography); HPLC-RID (HPLC-Refractive Index Detector); 1H NMR (proton nuclear magnetic resonance spectroscopy); TOCSY NMR (total correlation spectroscopy NMR); DEPT NMR (distortionless enhancement by polarization transfer NMR); HSQC NMR (heteronuclear single quantum coherence spectroscopy NMR); HMBC NMR (heteronuclear multiple bond correlation NMR); Acorn (Acorn NMR, Livermore, Calif.); HOPC (fold improvements over positive control); Sigma-Aldrich (Sigma-Aldrich, St. Louis, Mo.; Difco (Difco Laboratories, BD Diagnostic Systems, Detroit, Mich.); Microfluidics (Microfluidics, Westwood, Mass.); ChromaDex (ChromaDex, Inc., Irvine, Calif.); Eppendorf (Eppendorf, Inc., Enfield, Conn.); and Thermotron (Thermotron, Holland, Mich.).

EXAMPLE 1

Synthesis, Optimization and Screening of β-Glucosidase Enzymes

In this Example, experiments conducted to synthesize, optimize, and screen β-glucosidase enzymes having glucosylation activity are described.

Gene Synthesis and Optimization

The polynucleotide sequences encoding 18 wild-type GH1 and GH3 β-glucosidase polypeptides from *Sphingomonas* sp. (SEQ ID NO:343, encoding the polypeptide of SEQ ID NO:344), *Microbispora* sp. (SEQ ID NO:345, encoding the polypeptide of SEQ ID NO:346), *Sulfolobus* sp. (SEQ ID NO:347, encoding the polypeptide of SEQ ID NO:348), *Azospirillum* sp. (SEQ ID NO:349, encoding the polypep- tide of SEQ ID NO:350; and SEQ ID NO:353, encoding the polypeptide of SEQ ID NO:354), *Erwinia* sp. (SEQ ID NO:351, encoding the polypeptide of SEQ ID NO:352), *Gluconacetobacter* sp. (SEQ ID NO:355, encoding the polypeptide of SEQ ID NO:356), *Cellvibrio* sp. (SEQ ID NO:357, encoding the polypeptide of SEQ ID NO:358), *Bacteroides* sp. (SEQ ID NO: 1, encoding the polypeptide of SEQ ID NO:2), *Escherichia* sp. (SEQ ID NO:361, encoding the polypeptide of SEQ ID NO:362), *Salmonella* sp. (SEQ ID NO:363, encoding the polypeptide of SEQ ID NO:364), *Prevotella* sp. (SEQ ID NO:365, encoding the polypeptide of SEQ ID NO:366; SEQ ID NO:367, encoding the polypeptide of SEQ ID NO:368), *Saccharopolyspora* sp. (SEQ ID NO:369, encoding the polypeptide of SEQ ID NO:370; and SEQ ID NO:373, encoding the polypeptide of SEQ ID NO:374), *Cellulomonas* sp. (SEQ ID NO:375, encoding the polypeptide of SEQ ID NO:376), *Rhodococcus* sp. (SEQ ID NO:371, encoding the polypeptide of SEQ ID NO:372), and an uncultured organism (SEQ ID NO:359, encoding the polypeptide of SEQ ID NO:360) were codon-optimized, synthesized, and cloned into a pCK110900 vector system (See e.g., US Pat. Appln. Publn. No. 20060195947, hereby incorporated by reference herein) and subsequently expressed in *E. coli* W3110 (ΔfhuA). The *E. coli* strain W3110 expressed the GH1 and GH3 enzymes under the control of the lac promoter.

Production of High-Throughput (HTP) Lysates

*E. coli* cells expressing the polypeptide genes of interest were grown and induced in 96-well plates, pelleted, lysed in 250 μL lysis buffer (0.5 g/L lysozyme and 0.5 g/L PMBS in 20 mM Tris-HCl buffer, pH 7.5) with low-speed shaking for 2 h on titre-plate shaker at room temperature. The plates were then centrifuged at 4000 rpm and 4° C. for 20 min and the cleared lysate supernatants were used in the assay reactions described below.

Production of Shake Flask Powders (SFP)

A shake-flask procedure was used to generate the glycosyltransferase polypeptide shake flask powders (SIT) for characterization assays and were used to carry out the biocatalytic processes described herein. Shake flask powder (SFP) preparation of enzymes provides a more purified preparation (e.g., up to 30% of total protein) of the enzyme as compared to the cell lysate used in HTP assays. In addition, they allow for the use of more concentrated enzyme solutions. A single colony of *E. coli* containing a plasmid encoding an engineered polypeptide of interest was inoculated into 5 mL Luria Bertani broth containing 30 μg/ml chloramphenicol and 1% glucose. Cells were grown overnight (at least 16 hours) in an incubator at 30° C. with shaking at 250 rpm. The culture was diluted into 250 mL Terrific Broth (12 g/L bacto-tryptone, 24 g/L yeast extract, 4 mL/L glycerol, 65 mM potassium phosphate, pH 7.0, 1 mM MgS0$_4$) containing 30 μg/ml CAM, in a 1 L flask to an optical density of 600 nm (OD600) of 0.2 and allowed to grow at 30° C. Expression of the glycosyltransferase gene was induced by addition of IPTG to a final concentration of 1 mM when the OD600 of the culture was 0.6 to 0.8. Incubation was then continued overnight (at least 16 hours). Cells were harvested by centrifugation (5000 rpm, 15 min, 4° C.) and the supernatant discarded. The cell pellet was resuspended in two volumes of 25 mM triethanolamine buffer. pH 7.5 and passed through a MICROFLUIDIZER® high pressure homogenizer (Microfluidics), with standard *E.* coli lysis settings and maintained at 4° C. Cell debris was removed by centrifugation (10,000 rpm, 45 minutes, 4° C.). The clear lysate supernatant was collected and frozen at −80° C. and then lyophilized to produce a dry shake-flask powder of crude polypeptide.

Assay for Cellobiose Synthesis

In this assay, 50 µL of HTP lysates were diluted in 200 µL total reaction volume of 50 mM sodium acetate buffer, pH 5.5 and 100 g/L glucose. The reaction was performed at 40° C. in a Thermotron titre plate shaker with 300 RPM shaking for 16-18 h.

HPLC Analysis of Cellobiose Synthesis Assay

The cellobiose synthesis reaction above was quenched with 0.5 volume/volume acetonitrile with 2% formic acid and precipitated by centrifugation. Cellobiose was detected in the supernatant by HPLC-RID with the following instrument and parameters:

TABLE 1.1

| HPLC Analysis Instrument and Parameters | |
|---|---|
| Instrument | Agilent HPLC 1200 series |
| Column | Aminex HPX-87H 7.8 × 300 mm (Biorad) |
| Mobile phase | 5 mM sulfuric acid |
| Flow rate | 0.6 mL/m |
| Run time | 18 m |
| Peak retention times | Cellobiose: 7.417, Glucose: 9.023 m |
| Column temperature | 65° C. |
| Injection volume | 20 µL |
| Refractive index detection | |

Single colonies of E. coli containing a plasmid containing the three sequences encoding β-glucosidases that catalyzed the greatest cellobiose formation were used to prepare SFP.

Assay for Steviol Glycoside Glucosylation

SFP was reconstituted to provide 20 g/L powder. Then, 10 µL of these stocks were diluted in 200 µL total reaction volume of 50 mM sodium phosphate buffer, pH 7, with 0.5 mM stevioside (ChromaDex, >94% purity) or rebaudioside A (Sigma, >96% purity), with 50 µM-5 mM glucose or cellobiose. The reaction was performed at 30° C. in a Thermotron titre-plate shaker with 300 RPM shaking for 2 h.

HPLC-MS/MS Analysis of Steviol Glycoside Glucosylation Assay

The steviol glycoside glucosylation reaction described above was quenched with 0.5 volume/volume acetonitrile with 2% formic acid and precipitated by centrifugation. Glycosylated stevioside products were detected in the supernatant by LC-MS/MS with the following instrument and parameters:

TABLE 1.2

| HPLC MS/MS Instrument and Parameters | |
|---|---|
| Instrument | Agilent HPLC 1200 series, Sciex 4000 QTrap |
| Column | Poroshell 120 EC C18 50 × 3.0 mm, 2.7 µm with Poroshell 120 EC C18 5 × 3.0 mm, 2.7 µm guard column (Agilent Technologies) |

TABLE 1.2-continued

| HPLC MS/MS Instrument and Parameters | |
|---|---|
| Mobile phase | Gradient (A: 0.1% formic acid in water; B: 0.1% formic acid in methanol) |

| Time (m) | % B |
|---|---|
| 0 | 60 |
| 0.50 | 60 |
| 1.00 | 70 |
| 4.33 | 70 |
| 5.00 | 95 |
| 5.33 | 95 |
| 5.34 | 60 |
| 6.00 | 60 |

| | |
|---|---|
| Flow rate | 0.8 mL/m |
| Run time | 6 m |
| Peak retention times | Rebaudioside A: 2.35 m, Stevioside: 2.32 m, Rebaudioside D: 1.47 m, Rebaudioside M: 1.73 m, Product 180: 1.80 m, Product 206: 2.06 m, Product 220: 2.20 m, Rubusoside: 2.72 m. |
| Column temperature | 40° C. |
| Injection volume | 10 µL |
| MS detection | Sciex 4000 QTrap; MRM 990/828 (for steviol tetraglycosides, e.g., rebaudioside A), 1152/828 (for steviol pentaglycosides, e.g., rebaudioside D), 1314/828 (steviol hexaglycosides, e.g., rebaudioside M), 828/666 (for steviol triglycosides; e.g., stevioside), 666/504 (steviol diglycosides, e.g., rubusoside) |
| MS conditions | MODE: MRM; CUR: 30; IS: 4750; CAD: high; TEM: 550° C.; GS1: 50; GS2: 50; DP: 150; EP: 10; CXP: 14; DT: 50 ms for each transition For the first three transitions: CE: 85 For the last two transitions: CE: 60 |

The main activity on stevioside detected for all three β-glucosidases was hydrolysis of stevioside to rubusoside, yet one GH3 enzyme from Bacteroides fragilis encoded by SEQ ID NO: 11 produced a significant peak over the negative control with a retention time identical to rebaudioside A. The use of this enzyme as a biocatalytic reagent provides a novel method for the β-glucosylation of stevioside. The activity was pH and glucose-donor-independent. Rebaudioside A as a substrate was not hydrolyzed.

EXAMPLE 2

Evolution and Screening of Engineered GH3 Polypeptides

In this Example, evolution and screening of engineered GH3 polypeptides derived from SEQ ID NO: 11 for improved transglucosylation activity to form β-glucosylated products are described. Directed evolution of the β-glucosidase gene encoded by SEQ ID NO: 11 was carried out by constructing libraries of variant genes in which positions associated with computer modeling of the enzyme structure docked to the stevioside substrate and residue positions associated with the active site and other structural features were subjected to mutagenesis. These libraries were then plated, grown, and screened using the HTP assay described below to provide a first round ("Round 1") of 68 engineered β-glucosidase GH3 variant polypeptides with glucosylation/transglucosylation activity toward stevioside.

HTP Growth, Expression, and Lysate Preparation

Cells were picked into 96-well plates and grown overnight in LB media containing 1% glucose and 30 µg/mL CAM, 30° C., 200 rpm, 85% humidity. Then, 20 µL of overnight growth were transferred to a deep-well plate containing 380 µL TB growth media containing 30 µg/mL CAM, 1 mM IPTG, and incubated for 18 h at 30° C., 200 rpm, 85% humidity. Cell cultures were centrifuged at 4000 rpm, 4° C. for 10 m, and the media discarded. Cell pellets thus obtained were frozen at −80° C. and used to prepare lysate for HTP reactions as described in Example 1.

HTP Assay for Stevioside Transglueosylation

Assays were performed on 96-well control plates of *E. coli* cultures expressing SEQ ID NO: 11 with lysate loadings of 5-50 µL lysate in 200 µL reactions and with substrate loadings of 0.5-5 mM stevioside from a 20 mM stock solution in 50% ethanol. The following reaction conditions were selected in order to minimize assay cofficients of variation and maximize the possibility of activity hits: 20 µL HTP lysates were diluted in 200 µL total reaction volume of 50 mM sodium acetate buffer, pH 5.5, with 2 mM stevioside (ChromaDex, >94% purity), with 100 g/L cellobiose. The reaction was performed at 45° C. in a Thermotron titre-plate shaker with 300 RPM shaking for 1 h.

HPLC-MS/MS Analysis of Stevioside Transglucosylation Assay

The stevioside transgiucosylation reaction described above was quenched with 0.5 volume/volume acetonitrile with 2% formic acid and precipitated by centrifugation. Glycosylated stevioside products were detected in the supernatant by LC-MS/MS with the instrument and parameters described in Example 1, Table 1.2.

β-glucosidase GH3 variant polypeptides were identified that produced rebaudioside A as well as Product 180 and Product 220, products not present in the negative control with mass transitions consistent with glucosylation of stevioside, all of which were novel activities for this enzyme. The engineered polypeptides are listed in Table 2.1. SFPs were produced as described in Example 1 for variants with the following amino acid mutations relative to SEQ ID NO 12: V70W, Y266G, V32S, T38E, F233L, S125G, and T37W.

TABLE 2.1

Variants and Reaction Products

| SEQ ID NO: (nt/aa) | Amino Acid Differences (Relative to SEQ ID NO: 12) | Increased RebA[a] | Increased Product 180[b] | Increased Product 220[b] |
|---|---|---|---|---|
| 21/22 | V70W | +++ | − | − |
| 73/24 | R66G | ++ | − | + |
| 25/26 | T37W | ++ | − | + |
| 27/28 | T38E | ++ | − | + |
| 29/30 | C184A | ++ | − | − |
| 31/32 | F233L | ++ | − | − |
| 33/34 | F450G | ++ | − | − |
| 35/36 | L61R | ++ | − | − |
| 37/38 | P31C | ++ | − | − |
| 39/40 | P31G | ++ | − | − |
| 41/42 | S125G | ++ | − | − |
| 43/44 | T37K | ++ | − | − |
| 45/46 | A124D; V297P | − | +++ | ++ |
| 47/48 | F59R | − | ++ | +++ |
| 49/50 | G57R; I91P | − | ++ | +++ |
| 51/52 | K62P; W403R | − | ++ | +++ |
| 53/54 | C184R | − | + | +++ |
| 55/56 | E150L | − | + | +++ |
| 57/58 | F133G | − | + | +++ |
| 59/60 | H187G | − | + | +++ |
| 61/62 | H187N | − | + | +++ |
| 63/64 | Y266G | − | + | +++ |
| 65/66 | N60V | + | + | ++ |
| 67/68 | V297R | + | + | ++ |
| 69/70 | E150M | − | + | + |
| 71/72 | M230F | − | + | + |
| 73/74 | M230H | − | + | + |
| 75/76 | F601A | − | + | − |
| 77/78 | D89L | − | − | +++ |
| 79/80 | K186E | − | − | +++ |
| 81/82 | V405R | − | − | +++ |
| 83/84 | W403E | − | − | +++ |
| 85/86 | N60C | + | − | ++ |
| 87/88 | D138G; M296S | − | − | ++ |
| 89/90 | D89S; H187R | − | − | ++ |
| 91/92 | E150H | − | − | ++ |
| 93/94 | F233P | − | − | ++ |
| 95/96 | F601E | − | − | ++ |
| 97/98 | F601L | − | − | ++ |
| 99/100 | G34I | − | − | ++ |
| 101/102 | I36P | − | − | ++ |
| 103/104 | I91G; G595V | − | − | ++ |
| 105/106 | N60R | − | − | ++ |
| 107/108 | V32G | − | − | ++ |
| 109/110 | W403P | − | − | ++ |
| 111/112 | A231G | + | − | + |
| 113/114 | G34P | + | − | + |
| 115/116 | M230I | + | − | + |
| 117/118 | R66N | + | − | + |
| 119/120 | V32S | + | − | + |
| 121/122 | Y266F | + | − | + |
| 123/124 | A126V; F188R | − | − | + |
| 125/126 | A231R | − | − | + |
| 127/128 | E150P | − | − | + |
| 129/130 | E150T | − | − | + |
| 131/132 | F133R | − | − | + |
| 133/134 | F233Q | − | − | + |
| 135/136 | H187Y | − | − | + |
| 137/138 | K62N | − | − | + |
| 139/140 | L58P | − | − | + |
| 141/142 | M296R | − | − | + |
| 143/144 | M296T | − | − | + |
| 145/146 | M449G | − | − | + |
| 147/148 | M449P | − | − | + |
| 149/150 | R147L | − | − | + |
| 151/157 | R590W | − | − | + |
| 153/154 | S492P | − | − | + |
| 155/156 | V32P | − | − | + |

[a]Levels of increased production were determined relative to the reference polypeptide of SEQ ID NO: 12 and defined as follows: "−" = activity less than 0.6-fold the reference polypeptide; "+" = activity at least 0.6-fold but less than 1.4-fold reference polypeptide; "++" = at least 1.4-fold but less than 2.2-fold increased activity; "+++" = at least 2.2-fold but less than 2.5-fold increased activity.
[b]Levels of increased production were determined relative to the reference polypeptide of SEQ ID NO: 12and defined as follows: "−" = activity less than 5-fold the reference polypeptide; "+" = activity at least 5-fold but less than 15-fold reference polypeptide; "++" = at least 15-fold but less than 25-fold increased activity; "+++" = at least 25-fold but less than 170-fold increased activity.

SFP Characterization Assay for Steviol Glycoside Transglucosylation

SFP was reconstituted to provide 20 g/L powder. Then, 10 µL of these stocks were diluted in 200 µL total reaction volume of 50 mM sodium acetate buffer, pH 5.5, with 2 mM stevioside (ChromaDex, >94% purity), rebaudioside A (Sigma, >96% purity), or rebaudioside D (Sigma, >93% purity), with or without 100 g/L cellobiose. The reaction was performed at 45° C. in a Thermotron titre-plate shaker with 300 RPM shaking for 1 h.

HPLC-MS/MS Analysis of Steviol Glycoside Transglucosylation

The steviol glycoside transglucosylation reaction described above was quenched with 0.5 volume/volume acetonitrile with 2% formic acid and precipitated by centrifugation. Glycosylated stevioside products were detected in the supernatant by LC-MS/MS with the instrument and parameters described in Example 1, Table 1.2. Variants with mutations V70W, V32S, T38E, F233L, S125G, and T37W (SEQ ID NO: 22, 120, 28, 32, 42, 26) produced rebaudioside A from stevioside, both with and without cellobiose. The variant with mutation Y266G (SEQ ID NO: 64) produced Product 180 and Product 220 almost exclusively in the presence of cellobiose, and the cellobiose requirement confirms that activity is occurring by transalucosylation. No activity was observed from variants with mutations V70W, V32S, T38E, F233L, S125G, and T37W (SEQ ID NO: 22, 120, 28, 32, 42, 26) on rebaudioside A as the substrate. With rebaudioside D as the substrate, hydrolysis to rebaudioside A was the major product and glycosylation to rebaudioside M was detected for the wild-type and variants F233L, V70W, S125G, and T37W (SEQ ID NO: 12, 32, 22, 42, 26). These engineered enzymes provide novel biocatalytic reagents in novel methods for the β-glucosylation of stevioside to rebaudioside A and other products and of rebaudioside D to rebaudioside M.

Reaction Scale-up, Compound Purification, and NMR Characterization

SFP from *E. coli* expressing SEQ ID NO: 11 was produced as described in Example 1. SFP was reconstituted to provide 20 g/L powder. Then. 11 mL of this stock was diluted in 250 mL total reaction volume in each of four 1L-shake flasks of 100 mM sodium acetate buffer, pH 5.5, with 8 g/L stevioside (ChromaDex, >91% purity). The reaction was performed at 45° C. in an Innova® (New Brunswick, Eppendorf) shaking incubator with 250 RPM shaking for 3 h 40 m and quenched to pH<4 with 0.5 mL formic acid. The reaction was precipitated by centrifugation at 10,000 RPM for 10 in at 4° C. 7.5 g XAD-4 resin (Sigma) were added to each supernatant and incubated in shake flasks for 16-24 h. The resin was filtered, washed with water, and eluted with 25-50 mL 80:20 acetonitrile: water by incubating several hours and re-filtering. The eluent was concentrated to about 2 mL by rotary evaporation, filtered through WHATMAN® UNIPREP® syringeless filters (Sigma-Aldrich), and fractionated by HPLC using the following instrument and parameters:

TABLE 2.2

| HPLC | Instrument and Parameters |
| --- | --- |
| Instrument | Agilent HPLC 1200 series |
| Column | Supelcosil LC-NH2 250 × 4 mm, 5 μm (Sigma) |
| Mobile phase | Isocratic 80% B (A: 0.1% formic acid in water; B: 0.1% formic acid in acetonitrile) |
| Flow rate | 0.8 mL/m |
| Run time | 12 m |
| Peak retention times | Rebaudioside A: 11.21 m, Stevioside: 7.57 m, Rubusoside: 4.51 m. |
| Column temperature | 40° C. |
| Injection volume | 100 μL |
| UV detection | 210 nm, 8 nm bandwidth, 2 s response time |

Fractions were manually collected at retention times 2.5-4.7, 4.7-7.9, 7.9-10, and 10.4-11.5 m. The third 7.9-10 m fractions were pooled and concentrated by rotary evaporation, filtered through WHATMAN® UNIPREP® syringeless filters (Sigma-Aldrich), and fractionated by HPLC using the following instrument and parameters:

TABLE 2.3

| HPLC Instrument and Parameters | |
| --- | --- |
| Instrument | Agilent HPLC 1200 series |
| Column | Higgins C18 250 × 10 mm, 5 μm (Higgins Analytical) |
| Mobile phase | Isocratic 32% B (A: 0.1% formic acid in water; B: 0.1% formic acid in acetonitrile) |
| Flow rate | 2.5 mL/m |
| Run time | 12.5 m |
| Peak retention times | Rebaudioside A: 6.472 m, Rubusoside: 13.7 m. |
| Column temperature | 40° C. |
| Injection volume | 100 μL |
| UV detection | 210 nm, 8 nm bandwidth, 2 s response time |

Figure 2:
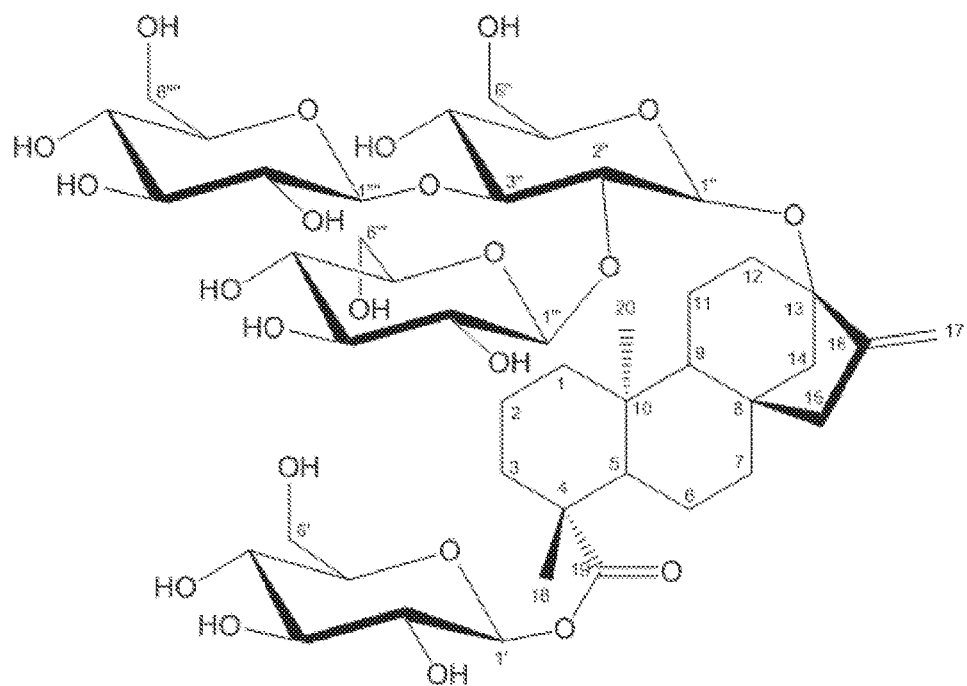
FIG. 2 provides the structure of rebaudioside A, with the carbons numbered.

Fractions were manually collected at retention times 6-6.7 m, pooled, and lyophilized. The lyophilized sample was resuspended in methanol-d4 and then freeze dried again. This sample was resuspended in pyridine-d5 and used for 1H NMR spectra acquisition. The sample's retention time on the amino and C18 columns and the 1H spectrum are all consistent with those of a rebaudioside A standard (Sigma, >96%). The structure of rebaudioside A with numbered carbons is shown in FIG. 2, and the shift assignments are provided in Table 2.4.

TABLE 2.4

| Rebaudioside A Standard NMR Assignments | | |
| --- | --- | --- |
| Label | δ $^{13}$C (ppm) | δ $^1$H (ppm) |
| 19 | 176.9 | — |
| 16 | 154.0 | — |
| 1''' | 104.6 | 5.56 |
| 1'''' | 104.6 | 5.33 |
| 17 | 104.4 | 5.64, 5.01 |
| 1'' | 98.1 | 5.07 |
| 1' | 95.6 | 6.13 |
| 3'' | 87.8 | 4.15 |
| 13 | 86.3 | — |
| 2'' | 80.6 | 4.37 |
| 5' | 79.1 | 3.96 |
| 3' | 78.8 | 4.19 |
| 5'''' | 78.5 | 4.09 |
| 3'''' | 78.3 | 4.22 |
| 3''' | 78.1 | 4.27 |
| 5''' | 78.0 | 3.94 |
| 5'' | 77.2 | 3.79 |
| 2''' | 76.1 | 4.20 |
| 2'''' | 75.1 | 4.07 |
| 2' | 73.7 | 4.14 |
| 4' | 71.7 | 4.29 |
| 4'''' | 71.3 | 4.20 |
| 4''' | 70.8 | 4.29 |
| 4'' | 70.5 | 3.87 |
| 6''' | 62.7 | 4.49, 4.41 |
| 6'' | 62.5 | 4.48, 4.09 |
| 6'''' | 62.2 | 4.57, 4.33 |
| 6' | 61.9 | 4.43, 4.36 |
| 5 | 57.2 | 1.05 |
| 9 | 53.8 | 0.90 |
| 15 | 53.8 | 0.90 |
| 14 | 44.3 | 2.66, 1.81 |
| 4 | 43.8 | — |
| 8 | 42.4 | — |
| 7 | 41.5 | 1.31 |
| 1 | 40.5 | 1.76, 0.77 |
| 10 | 39.6 | — |
| 3 | 38.2 | 2.36, 1.04 |
| 12 | 36.7 | 2.26, 2.00 |

TABLE 2.4-continued

Rebaudioside A Standard NMR Assignments

| Label | δ $^{13}$C (ppm) | δ $^{1}$H (ppm) |
|---|---|---|
| 18 | 28.1 | 1.25 |
| 6 | 22.0 | 2.47, 1.93 |
| 11 | 20.4 | 1.69 |
| 2 | 19.2 | 2.24, 1.46 |
| 20 | 15.3 | 1.32 |

EXAMPLE 3

Evolution and Screening of Engineered GH3 Polypeptides

In this Example, evolution and screening of engineered GH3 polypeptides derived from SEQ ID NO: 12 for reduced hydrolysis of stevioside are described.

Using the assay described in Example 2 for stevioside transglucosylation, β-glucosidase GH3 variant polypeptides were identified that exhibited reduced hydrolysis of the stevioside substrate. These engineered polypeptides are listed in Table 3.1. Reducing hydrolysis while maintaining or increasing transglucosylation activity is useful for novel engineered β-glucosidases used for steviol glycoside transglucosylation.

TABLE 3.1

β-Glucosidase Variants

| SEQ ID NO: (nt/aa) | Amino Acid Differences (Relative to SEQ ID NO: 12) | Decreased Hydrolysis$^a$ |
|---|---|---|
| 45/46 | A124D; V297P | +++ |
| 51/52 | K62P; W403R | +++ |
| 69/70 | E150M | +++ |
| 73/74 | M230H | +++ |
| 75/76 | F601A | +++ |
| 131/132 | F133R | +++ |
| 135/136 | H187Y | ++ |
| 47/48 | F59R | ++ |
| 49/50 | G57R; I91P | ++ |
| 53/54 | C184R | ++ |
| 55/56 | E150L | ++ |
| 57/58 | F133G | ++ |
| 59/60 | H187G | ++ |
| 77/78 | D89L | ++ |
| 79/80 | K186E | ++ |
| 81/82 | V405R | ++ |
| 83/84 | W403E | ++ |
| 87/88 | D138G; M296S | ++ |
| 93/94 | F233P | ++ |
| 95/96 | F601E | ++ |
| 97/98 | F601L | ++ |
| 123/124 | A126V; F188R | ++ |
| 125/126 | A231R | ++ |
| 127/128 | E150P | ++ |
| 129/130 | E150T | ++ |
| 133/134 | F233Q | ++ |
| 139/140 | L58P | ++ |
| 149/150 | R147L | ++ |
| 151/152 | R590W | ++ |
| 157/158 | H187N | + |
| 159/160 | Y266G | + |
| 161/162 | N60V | + |
| 163/164 | V297R | + |
| 165/166 | M230F | + |
| 167/168 | N60C | + |
| 169/170 | D89S; H187R | + |
| 171/172 | E150H | + |
| 99/100 | G34I | + |
| 101/102 | I36P | + |
| 103/104 | I91G; G595V | + |
| 105/106 | N60R | + |
| 107/108 | V32G | + |
| 109/110 | W403P | + |
| 111/112 | A231G | + |
| 113/114 | G34P | + |
| 115/116 | M230I | + |
| 117/118 | R66N | + |
| 119/120 | V32S | + |
| 121/122 | Y266F | + |
| 137/138 | K62N | + |
| 141/142 | M296R | + |
| 143/144 | M296T | + |
| 145/146 | M449G | + |
| 147/148 | M449P | + |
| 153/154 | S492P | + |
| 155/156 | V32P | + |

$^a$Levels of decreased hydrolysis were determined as stevioside peak area relative to the reference polypeptide of SEQ ID NO: 12 and defined as follows: "+" = activity at least 1.5-fold but less than 3-fold reference polypeptide; "++" = at least 3-fold but less than 4.5-fold; "+++" = at least 4.5-fold but less than 15-fold.

EXAMPLE 4

Synthesis, Optimization, and Screening of GH1 Enzymes

In this Example, experiments conducted to synthesize, optimize and screen GH1 enzymes having glucosylation activity are described.

Gene Synthesis and Optimization

The polynucleotide sequences encoding 4 wild-type GH1 β-glucosidase polypeptides from *Thermotoga neapolitana*, *Thermobaculum terrenum*, *Clostridium thermocellum*, and an unknown species designated as td2f2 (See, Uchiyama, Miyazaki, and Yaol, J. Biol. Chem. 288:18325 [2013]), namely SEQ ID NO: 5, 7, 9, and 3, respectively, were codon optimized, synthesized, and cloned as SEQ ID NO: 15, 17, 19, and 13 into a pCK 110900 vector system (See e.g., US Pat. Appln, Publn. No. 20060195947, hereby incorporated by reference herein) and subsequently expressed in *E. coli* W3110 (ΔfhuA). The *E. coli* strain W3110 expressed the GH1 enzymes under the control of the lac promoter. Shake flask powders (SFPs) were produced as described in Example 1.

Assay of SFP for Transglycosylation of Stevioside

SFP was reconstituted to provide 20 g/L powder. Then, 1-50 μL of these stocks were diluted in 200 μL total reaction volume of 50 mM sodium acetate buffer, pH 5.5, with 1-2 mM stevioside (ChromaDex, >94% purity) with 100 g/L cellobiose. The reaction was performed at 45-60° C. in a Thermotron titre-plate shaker with 300 RPM shaking with time points at 0-2 h and in some cases 18 h.

HPLC-MS/MS Analysis of Transglycosylation of Stevioside

The stevioside transglycosylation reactions described above were quenched with 0.5 volume/volume acetonitrile with 2% formic acid and precipitated by centrifugation. Glycosylated stevioside products were detected in the supernatant by LC-MS/MS with the instrument and parameters described in Example 1, Table 1.2.

For the td2f2 enzyme expressed from SEQ ID NO: 13, monoglucosylated stevioside products were observed at retention times 1.71, 1.82, 2.05, and 2.21 m, and diglucosylated products at 1.25, 1.33, 1.39, 1.58, and 1.67 m. Product formation did not plateau within 2 h, and little hydrolysis was detected as formation of rubusoside.

For the *Thermotoga neapolitana* enzyme expressed from SEQ ID NO: 15, monoglucosylated stevioside products were observed at retention times 1.84, 2.08, 2.23, and 2.29 m, and diglucosylated products at 1.40 and 1.77 m. Product formation increased over 2 h but decreased by 18 h, due to hydrolysis of products and stevioside detected as formation of rubusoside.

For the *Thermobaculum terrenum* enzyme expressed from SEQ ID NO: 17, monoglucosylated stevioside products were observed at retention times 1.80 and 2.27 m. Product formation increased over 1 h but decreased afterward, due to hydrolysis of the products and stevioside substrate detected as formation of rubusoside.

For the *Clostridium thermocellum* enzyme expressed from SEQ ID NO: 19, monoglucosylated stevioside products were observed at retention times 1.79, 2.04, 2.20, and 2.25 m. Product formation increased over 2 h but decreased by 18 h, due to hydrolysis of the products and stevioside substrate detected as formation of rubusoside.

Of the four GH1 enzymes assayed, the one from td2f2, SEQ ID NO: 13, produced the greatest concentration of mono- and di-glucosylated stevioside products.

Assay of SFP for Transglycosylation of Steviol Glycosides

SFP from SEQ ID NO: 13 was reconstituted to provide 20 g/L powder. Then, 10 μL of this stock was diluted in 200 μL total reaction volume of 50 mM sodium acetate buffer, pH 5.5, with 2 mM stevioside (ChromaDex, >94% purity), rebaudioside A (Sigma, >96% purity), or rebaudioside D (Sigma, >93% purity with or without 100 g/L cellobiose. The reaction was performed at 45° C. in a Thermotron titre-plate shaker with 300 RPM shaking for 1 h.

HPLC-MS/MS Analysis of Transglycosylation of Steviol Glycosides

The steviol glycoside transalycosylation reaction described above was quenched with 0.5 volume/volume acetonitrile with 2% formic acid and precipitated by centrifugation. Glycosylated stevioside products were detected in the supernatant by LC-MS/MS with the instrument and parameters described in Example 1, Table 1.2. For stevioside as substrate, the same mono-glucosylated products were observed. For rebaudioside A as substrate, mono-glucosylated products at retention times 1.45 and 1.66 m were observed. For rebaudioside D as substrate, mono-glucosylated products at retention times 1.25, 1.33, and 1.74 m were observed. The products from all three substrates were observed almost exclusively in the presence of cellobiose, and the cellobiose requirement confirms that activity is occurring by transglucosylation. These enzymes find use as biocatalytic reagents in novel methods for the β-glucosylation of steviol glycosides.

EXAMPLE 5

Evolution and Screening of GH1 Polypeptides

In this Example, experiments for evolution and screening of GH1 polypeptides derived from SEQ ID NO: 14 for improved transglucosylation activity to form β-glucosylated products are described.

Directed evolution of the β-glucosidase gene encoded by SEQ ID NO: 13 was carried out by constructing libraries of variant genes in which positions associated with computer modeling of the enzyme structure docked to the stevioside substrate and residue positions associated with the active site and other structural features were subjected to mutagenesis. These libraries were then plated, grown, and screened using the HTP assay described below to provide a first round ("Round 1") of 61 engineered β-glucosidase GH1 variant polypeptides with transglucosylation activity toward stevioside. HTP growth, expression, and lysate preparation were conducted as described in Example 2.

HTP Assay for Stevioside Transglucosylation

Assays were performed on 96-well control plates of *E. coli* cultures expressing SEQ ID NO: 13 with lysate loadings of 5-50 μL lysate in 200 μL reactions and with 0.5-5 mM stevioside and 100 g/L cellobiose. The following reaction conditions were selected in order to minimize assay coefficients of variation and maximize the possibility of activity hits: 20 μL or 50 μL HTP lysates were diluted in 200 μL total reaction volume of 50 mM sodium acetate buffer, pH 5.5, with 1 mM stevioside (ChromaDex, >94% purity), with 100 g/L cellobiose. The reaction was performed at 60° C. in a Thermotron titre-plate shaker with 300 RPM shaking for 1 or 2 h.

HPLC-MS/MS Analysis of Stevioside Transglucosylation

The stevioside transglucosylation reaction described above was quenched with 0.5 volume/volume acetonitrile with 2% formic acid and precipitated by centrifugation. Glycosylated stevioside products were detected in the supernatant by LC-MS/MS with the instrument and parameters described in Example 1, Table 1.2. β-glucosidase GH1 variant polypeptides were identified that produced increased mono-glucosylated stevioside products at retention times 1.71, 1.82, 2.05, and 2.21 at greater levels than the wild-type enzyme, as well as that produced a new mono-glucosylated product at retention time 2.27 m. These engineered polypeptides are listed in Table 5.1. Some engineered polypeptides produced greater levels of mono-glucosylated stevioside overall, while others produced greater levels of individual mono-glucosylated products. For example, variants with mutations W168L and W168G (SEQ ID NO: 173, 175) substantially increased products with retention times 1.82 and 2.05, but did not affect the product with retention time 2.21 m. For example, variants with mutations V247I and V247L (SEQ ID NO: 189, 191) increased all three products. In yet another example, variants with mutations N404P and N404S (SEQ ID NO: 279, 281) increased products with retention time 2.21 and 2.06 m, but not the product with retention time 1.80 m.

TABLE 5

β-Glucosidase GH1 Variants

| SEQ ID NO: (nt/aa) | Amino Acid Differences (Relative to SEQ ID NO: 14) | Increased Product 180[a] | Increased Product 220[a] | Increased Product 206[a] |
|---|---|---|---|---|
| 173/174 | W168L | ++++ | + | ++++ |
| 175/176 | W168G | +++ | − | ++++ |
| 177/178 | S170H | ++ | + | + |
| 179/180 | T225H | ++ | + | ++ |
| 181/182 | T225N | ++ | + | + |
| 183/184 | V179L | ++ | + | + |
| 185/186 | V179R | ++ | + | + |
| 187/188 | V247G | ++ | + | − |
| 189/190 | V247I | ++ | ++ | +++ |
| 191/192 | V247L | ++ | + | +++ |
| 193/194 | W168E | ++ | − | − |
| 195/196 | W168Q; A256V | ++ | − | + |
| 197/198 | W168S | ++ | − | +++ |
| 199/200 | A15S | + | ++ | ++ |
| 201/202 | A17G | + | ++ | ++++ |
| 203/204 | A356G | + | + | +++ |
| 205/206 | C55P | + | ++ | ++ |
| 207/208 | F405H | + | ++ | ++ |
| 209/210 | F405W | + | ++ | +++ |
| 211/212 | I21A | + | + | ++ |
| 213/214 | I21E | + | ++ | +++ |
| 215/216 | I21F | + | ++ | +++ |
| 217/218 | I21G | + | + | ++ |
| 219/220 | I21H | + | + | +++ |
| 221/222 | I21S | + | ++ | ++++ |
| 223/224 | I45L | + | ++ | ++ |
| 225/226 | L164Y | + | + | ++ |
| 227/228 | L402K | + | + | ++ |
| 229/230 | L411A | + | ++ | ++ |
| 231/232 | L411D | + | ++ | ++ |
| 233/234 | L411G | + | ++ | +++ |
| 235/236 | L411R | + | ++ | +++ |
| 237/238 | L411T | + | ++ | ++ |
| 239/240 | M409T | + | ++ | +++ |
| 241/242 | M413A | + | ++ | ++ |
| 243/244 | M413H | + | ++ | + |
| 245/246 | M413P | + | + | ++ |
| 247/248 | P215S; M413P | + | ++ | +++ |
| 249/250 | R313V | + | ++ | + |
| 251/252 | R414D | + | ++ | ++ |
| 2531254 | S412L | + | ++ | +++ |
| 255/256 | T16A | + | + | +++ |
| 257/258 | T16G | + | + | +++ |
| 259/260 | T351A | + | + | ++ |
| 261/262 | T351L | + | + | ++ |
| 263/264 | V221C | + | + | ++ |
| 265/266 | V221G | + | ++ | ++++ |
| 267/268 | V221T | + | + | +++ |
| 269/270 | W168K | + | − | +++ |
| 271/272 | Y19G | + | ++ | ++ |
| 273/274 | Y76G | + | + | ++ |
| 275/276 | Y76L | + | + | ++ |
| 277/278 | H121S | − | ++ | ++ |
| 279/280 | N404P | − | ++ | + |
| 281/282 | N404S | − | ++ | +++ |
| 283/284 | S79T | − | ++ | +++ |
| 285/286 | T16S; R84H | − | + | ++ |
| 287/288 | T225Y | − | − | +++ |
| 289/290 | V221P; A311V | − | + | ++ |
| 291/292 | W35A | − | ++ | − |
| 293/294 | W35G | − | ++ | − |

[a]Levels of increased production were determined relative to the reference polypeptide of SEQ ID NO: X and defined as follows: "+" = activity at least 0.6-fold but less than 1.4-fold reference polypeptide; "++" = at least 1.4-fold but less than 2.2-fold increased activity; "+++" = at least 2.2-fold but less than 10-fold increased activity.

Reaction Scale-up, Compound Purification, and NMR Characterization

SFP from *E. coli* expressing SEQ ID NO: 173 to produce the polypeptide of SEQ ID NO:174 was produced as described in Example 1. SFP was reconstituted to provide 20 g/L powder. Then, 12.5 mL of this stock was diluted in 250 mL total reaction volume in each of four 1L-shake flasks of 100 mM sodium acetate buffer, pH 5.5, with 1.6 g/L stevioside (ChromaDex, >91% purity). The reaction was performed at 45-60° C. in an Innova® shaking incubator with 250 RPM shaking for 2-24 h and quenched to pH <4 with 0.5 mL formic acid. The reaction was precipitated by centrifugation at 10,000 RPM for 10 m at 4° C. 7.5 g XAD-4 resin (Sigma) were added to each supernatant and incubated in shake flasks for 16-24 h. The resin was filtered, washed with water, and eluted with 25-50 mL 68:32 acetonitrile:water by incubating 16-24 h and re-filtering. The eluent was concentrated to about 2 mL by rotary evaporation, filtered through WHATMAN® UNIPREP® syringeless filters, and fractionated by HPLC using the instrument and parameters described in Example 1, Table 1.2. From the C18 column, fractions were manually collected at retention times 2.2-2.8, 2.8-3.3, 3.3-3.9, 3.9-4.5, 4.5-5.5, 5.5-6.2, and 6.2-8 m. Fractions were pooled and lyophilized. The fraction at 4.5-5.5 m was re-fractionated on the N112 column using the instrument and parameters described in Example 1, Table 1.2. Fractions were collected at retention time 9.7-10.7 m, pooled, and lyophilized. The samples were resuspended in pyridine-d5 and used for 1H, TOCSY, DEPT, HSQC, HMBC NMR spectra acquisition. The mono-glucosylated stevioside peak eluting at retention time 1.71 was determined to be stevioside β-glucosylated at the 6' position based on the observation that C-6' and one of the H-6' peaks were shifted downfield. This ring was identified as the first sugar from the TOCSY data, based on H-1' being farthest downfield. There was also an HMBC correlation from H-1''' to C-6'. The mono-glucosylated stevioside, peak eluting at retention time 1.82 was determined to be stevioside β-glucosylated at the 6'' position, based on the observation that C-6'' and one of the H-6'' peaks were shifted downfield. There were also HMBC correlations from H-2'' to C-1'' and C-1''' and from H-6'' to 1'''. NMR characterization was provided by Acorn.

EXAMPLE 6

Screening GH1 and GH3 Polypeptides

In this Example, experiments conducted to screen wild-type and engineered GH1 and GH3 polypeptides for transglucosylation of diverse substrates to form β-glucosylated products are described. SFPs were produced as described in Example 1 for *E. coli* expressing SEQ ID NOS: 17, 19, 11, 13, 191, and 173 to produce the polypeptide of SEQ ID NOS:18, 20, 12, 14, 192, and 174.

SFP Characterization Assay for 2-Naphthylmethanol Transglucosylation

SFPs of the enzymes encoded by SEQ ID NO: 13, 191, and 173 and a negative control were reconstituted to provide 20 g/L powder. Then, 50 μL of these stocks were diluted in 200 μL total reaction volume of 50 mM sodium acetate buffer, pH 5.5, with 1 mM naphthylmethanol (Sigma. 98% purity) with 100 g/L cellobiose. The reaction was performed at 60° C. in a Thermotron titre-plate shaker with 300 RPM shaking for 1 h.

HPLC-UV Analysis of 2-Naphthylmethanol Transglucosylation Assay

The 2-naphthylmethanol transglucosylation reaction described above was quenched with 0.5 volume/volume acetonitrile with 2% formic acid and precipitated by centrifugation. Glycosylated 2-naphthylmethanol was detected in the supernatant by LC-UV with the following instrument and parameters:

TABLE 6.1

| Instrument and Parameters | |
| --- | --- |
| Instrument | Agilent HPLC 1200 series |
| Column | Poroshell 120 EC C18 50 × 3.0 mm, 2.7 µm with Poroshell 120 EC C18 5 × 3.0 mm, 2.7 µm guard column (Agilent Technologies) |
| Mobile phase | Gradient (A: 0.1% formic acid in water; B: 0.1% formic acid in acetonitrile) |

| Time (m) | % B |
| --- | --- |
| 0 | 5 |
| 0.50 | 5 |
| 2.00 | 80 |
| 3.50 | 80 |
| 4.00 | 95 |
| 4.50 | 95 |
| 4.51 | 5 |

| | |
| --- | --- |
| Flow rate | 0.8 mL/m |
| Run time | 6 m |
| Peak retention times | 2-naphthylmethanol: 3.26 m; 2-naphthylmethanol β-glucose: 3.10 m |
| Column temperature | 40° C. |
| Injection volume | 2 µL |
| UV detection | 274 nm, 4 nm bandwidth, 2 s response time |

The three enzymes tested in this experiment exhibited 4-20% conversion of 2-naphthylmethanol to the glucosylated product, with SEQ ID NO: 13 having the highest activity, followed by SEQ ID NO: 191, and then SEQ ID NO: 173. Thus, the present invention provides wild-type and engineered β-glucosidases that find use in novel methods to β-glucosylate an aglycone non-natural product.

SFP Characterization Assay for 4-Methylumbelliferyl N-acetyl-β-D-Glucosaminidine Transglucosylation SFPs of the enzyme polypeptides encoded by SEQ ID NOS: 17, 19, 11, and 13 (i.e., SEQ ID NOS 18, 20, 12, and 14) were reconstituted to provide 20 g/L powder. Then, 10-50 µL of these stocks were diluted in 200 µL total reaction volume of 50 mM sodium acetate buffer, pH 5.5, with 2 mM 4-methylumbelliferyl N-acetyl-β-D-glucosaminidine (Sigma, >98%) with 100 g/L cellobiose. The reaction was performed at 45° C. in a Thermotron titre-plate shaker with 300 RPM shaking for 0-18 h.

HPLC-UV Analysis of 4-Methylumbelliferyl N-acetyl-β-D-Glucosaminidine Transglucosylation Assay The 4-methylumbelliferyl N-acetyl-β-D-glucosaminidine transglucosylation reaction described above was quenched with 0.5 volume/volume acetonitrile with 2% formic acid and precipitated by centrifugation. Glycosylated 4-methylumbelliferyl N-acetyl-β-D-glucosaminidine was detected in the supernatant by LC-UV with the following instrument and parameters:

TABLE 6.2

| Instrument and Parameters | |
| --- | --- |
| Instrument | Agilent HPLC 1200 series |
| Column | Poroshell 120 EC C18 50 × 3.0 mm, 2.7 µm with Poroshell 120 EC C18 5 × 3.0 min, 2.7 µm guard column (Agilent Technologies) |
| Mobile phase | Gradient (A: 0.1% formic acid in water; B: 0.1% formic acid in acetonitrile) |

| Time (m) | % B |
| --- | --- |
| 0 | 5 |
| 0.50 | 5 |
| 2.00 | 80 |
| 3.50 | 80 |
| 4.00 | 95 |
| 4.50 | 95 |
| 4.51 | 5 |

| | |
| --- | --- |
| Flow rate | 0.8 mL/m |
| Run time | 6 m |
| Peak retention times | 4-methylumbelliferyl N-acetyl-β-D-glucosaminidine: 2.958 m; 4-methylumbelliferyl N-acetyl-β-D-glucosaminidine β-glucose: 3.162 m |
| Column temperature | 40° C. |
| Injection volume | 2 µL |
| UV detection | 314 nm, 4 nm bandwidth, 0.5 s response time |

The three enzymes tested in this experiment exhibited <5% conversion of 4-methylumbelliferyl N-acetyl-β-D-glucosaminidine to the glucosylated product, with the enzyme polypeptide encoded by SEQ ID NO: 19 having the highest activity, followed by the enzyme polypeptides encoded SEQ ID NO: 17, and SEQ ID NO: 11. The enzyme polypeptide encoded by SEQ ID NO: 13 exhibited almost no activity. Thus, wild-type and engineered β-glucosidases find use in novel methods to β-glucosylate a glycosylated non-natural product.

EXAMPLE 7

Synthesis, Optimization, and Screening of GH2 Enzymes

In this Example, experiments on the synthesis, optimization and screening of GH2 enzymes having transglycosylation activity are described.

Gene Synthesis and Optimization

The polynucleotide sequences encoding 23 wild-type GH2 β-galactosidase polypeptides from *Escherichia* sp. (SEQ ID NO:295, encoding SEQ ID NO:296), *Oryza sativa* sp. (SEQ ID NO:297, encoding SEQ ID NO:298; SEQ ID NO: 299, encoding SEQ ID NO:300; SEQ ID NO:303, encoding SEQ ID NO:304; SEQ ID NO:313, encoding SEQ ID NO:314; SEQ ID NO:315, encoding SEQ ID NO:316; SEQ ID NO:317, encoding SEQ ID NO:318; and SEQ ID NO:327, encoding SEQ ID NO:328), *Sulfolobus* sp. (SEQ ID NO:301, encoding SEQ ID NO:302), *Halorubrum* sp. (SEQ ID NO:305, encoding SEQ ID NO:306), *Arabidopsis* sp. (SEQ ID NO:307, encoding SEQ ID NO:308 or SEQ ID NO:319, encoding SEQ ID NO:320), *Penicillium* sp. (SEQ ID NO:309, encoding SEQ ID NO: 310), *Dictyostelium* sp. (SEQ ID NO: 311, encoding SEQ ID NO:3012), *Pyrenophora* sp. (SEQ ID NO:321, encoding SEQ ID NO:322), *Neosartorya* sp. (SEQ ID NO:323, encoding SEQ ID NO: 324), *Bacteroides* sp. (SEQ ID NO:325, encoding SEQ ID NO:326), *Bacillus* sp. (SEQ ID NO:329, encoding SEQ ID NO:330), *Brassica* sp. (SEQ ID NO:331, encoding SEQ ID NO:332), *Leuconostoc* sp. (SEQ ID NO:333, encoding SEQ ID NO:334), *Thermoanaerobacterium* sp. (SEQ ID NO:335, encoding SEQ ID NO:336), *Xanthomonas* sp. (SEQ ID NO:337, encoding SEQ ID NO:338), *Serratia* sp. (SEQ ID NO:339, encoding SEQ ID NO:340), and *Lactobacillus* sp. (SEQ ID NO:341, encoding SEQ ID NO:342), were codon-optimized, synthesized, and cloned into a pCK110900 vector system (See e.g., US Pat. Appln. Publn. No. 20060195947, hereby incorporated by reference herein) and subsequently expressed in *E. coli* W3110 (ΔfhuA). The *E. coli* strain W3110 expressed the GH2 enzymes under the control of the lac promoter. High-throughput (HTP) lysates were prepared as described in Example 1.

Assay for Transgalactosylation of Stevioside

First, 50 µL of HTP lysates were diluted in 200 µL total reaction volume of 50 mM sodium acetate buffer, pH 5.5, 0.5 mM stevioside (ChromaDex, >94% purity) and 150 g/L lactose. The reaction was performed at 60° C. in a Thermotron titre-plate shaker with 300 RPM shaking for 16-18 h.

HPLC-MS/MS Analysis of Stevioside Transgalactosylation

The stevioside transgalactosylation reaction described above was quenched with 0.5 volume/volume acetonitrile with 2% formic acid and precipitated by centrifugation. Galactosylated stevioside products were detected in the supernatant by HPLC-MS/MS with the instrument and parameters described in Example 1, Table 1.2. Mono-galactosylated products were detected for several enzymes at retention times 1.67, 1.80, 1.97, and 2.14 m, and di-galactosylated products were detected at retention times 1.35, 1.45, and 1.57 m. The greatest activity was observed for the enzyme from *Escherichia coli* (SEQ ID NO: 295).

Assay for Transglucosylation of Stevioside

First, 50 µL of HTP lysates were diluted in 200 µL total reaction volume of 50 mM sodium acetate buffer, pH 5.5, 0.5 mM stevioside (Chromadex, >94% purity) and 150 g/L cellobiose. The reaction was performed at 60° C. in a Thermotron titre-plate shaker with 300 RPM shaking for 16-18 h.

HPLC-MS/MS Analysis of Stevioside Transglucosylation

The stevioside transglucosylation reaction described above was quenched with 0.5 volume/volume acetonitrile with 2% formic acid and precipitated by centrifugation. Glycosylated stevioside products were detected in the supernatant by HPLC-MS/MS with the instrument and parameters described in Example 1, Table 1.2. Mono-glycosylated products were detected for several enzymes at retention times 1.84, 1.97, 2.08, 2.23, and 2.29 m. The greatest activity was observed for the enzyme from *Escherichia coli* (SEQ ID NO: 295), followed by *Oryza sativa* (SEQ ID NO: 299).

SEQUENCE LISTING (294 sequences)

SEQ ID NO: 1 - DNA, 2226 bp, Artificial Sequence
  Wild type beta-glucosidase from Bacteroides
atgcagaaggctccccgggatatggaccgttttatcgaccagttaatgaaaaagatgacgctggaggagaagatcggccagctcaacctgcccgtgaccggagagatcactaccggacaggcgaaaagcagcgatgtagccaaacgaatccgtaacggagaggtgggaggactgttcaacctgaaaggagtggaacgcatccgtgaagtacagcggcaggcggtggaggagagccgcctcggcattcccttgttgttcggtatggacgtaatccacggatacgaaaccattttccctattcctctcggcctgtcgtgtacctgggatatgaaagccatcgaagagtccgcccgtatagctgccgtcgaagccagtgccgacggtatctcgtggacattcagcccgatggtggacgtcagccgtgacccgcgctggggacgtgtgtccgaggggaacggtgaagacccgttcctcggcgcagccatcgcccgtgccatgatacgcggataccagggaaaggatatgagccggaatgacgagataatggcttgtgtgaagcatttcgccctttatggagcatcagaggcggggcgcgattataatacggtggatatgagccgccagcgtatgttcaatgaatacatgctgccctatcaggccgcagtcgaggcaggtgtcggcagcgtaatggcttcgttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccctcgccctgaatgccggggtggatatggacatggtgagcgatgccttcagcggcactctgaagaagtcggtggaggaaggcaaagtatccgcagctgccatcgacgccgcctgccgccgtattctggaagcgaagtataagctgggactgtttgacaatccttataaatattgcgacgtgaatcgtcccaagaagcagatcttcaccaaggaacaccgtgccattgcccgtaagactgcttcggagagctttgtgctgctgaagaatgaaggtgtgttgccactcagcaagaaaggaaccattgccgtagtcggtccgttggcgaacacccgttccaacatgccgggcacctggagcgtagctgctgtgctggataacgctccctcgctggtcgaaggactcagggaagtagtcggtgaccgggcaaaagtggtaaccgccaagggaagcaatctgattggcgatgccgactatgagaagcgcgccaccatgttcggacgtgaactgcatcgggataaccgtacggatcgcgaacttctggacgaagctctgaaagtggctgccggggccgatgtcattgtcgccgcactgggcgagtcgtccgaaatgagtggagaaagcagttcgcgtaccaacctggagatgccggatgtacagagagcgctgttgcaggaattactcaaaaccggaaagcccgttgtgcttgtgctttttaccggtcgcccgctggtgctcacctgggaagaagaacacgtgcctgccatcctcaacgtatggttcggagggagtgaagccgcttatgccatcagcgatgtgcttttcggcgatgtcaatcccagtggaaaactgaccgctacttttccgcaaaatgtaggccagattccattgttctacaatcataaaaacaccgggcgtccgttgcaagagggacgttggtttgagaagttccgcagcaattacctcgacgtgagcaacgagccactctacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcctcaaggccggagagtctcgtaaagtaagcttcagcatcacgccggaattgttgaagttctataattacgatttgcagtttgtctgcgaaccgggtgatttcgatgtaatgattggcggaaacagccgggatgtaaaaaaggcacgatttcttctgaagggagaataa

SEQ ID NO: 2 - protein, 741 aa, Artificial Sequence
  Wild type beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 3 - DNA, 1338 bp, Artificial Sequence
  Wild type beta-glucosidase from uncultured td2f2
atggcaggagaacgattcccggctgactttgtctggggcgccgccaccgccgcctatcaaattgagggcgcggtgcgcgaggacgggcgcggcgtctcgatctgggacaccttcagccacacgcccggcaaaatcgccgacggcacgaccggcgatgtcgcctgcgattcctaccaccgctatggcgaagacatcggtctacttaacgcgcttggcatgaatgcctaccgcttcagcatcgcctggccgcgcatcgtcccgctcggtgccgggccgatcaaccaggcagggctggaccattacagccggatggtcgacgcgctgctcggcgcgggcctgcagccgttcgtcacgctctaccactgggacctgccgcagccgctggaagaccggctgggctggggcagccgggcgacggcgaccgtcttcgcggagtatgccgacatcgtcgtgcgccagctcggcgaccgggtgacgcactgggcgacgctcaacgagccgtggtgcagcgccatgctcggctactatctcggcgtgcacgcgccggggcacaccgacctgaagcgcgggctggaagcgtcgcacaacctgctgctcgggcacggcctggcggttcaggcgatgcgcgccgccgcgccgcagccgctgcagatcggtatcgtcctcaacctgaccccgacctatcccgcgtcagactcgccggaggacgttgccgctgcccgccgcttcgacggcttcgtcaaccgctggttcctcgacccgctggccggacgcggttatccgcaggatatgctcgactattacggcgcggccgcgccgcaggcgaatccggaagacctgacgcaaatcgcggcgccgctcgactggctgggcgtcaattactacgagcgcatgcgagccgtcgacgcgcctgacgcttcgctgccacaggcgcaacggctggatgatcctgacctgccacacacggccgaccgggaagtctacccggaagggctgtacgatattctgctgcggcttcacaacgactatccattccggccgctgtacatcaccgaaaacggctgcgcgttgcacgacgagattgcggaggacggcggcatccacgacgggcagcggcaggcgttcttcgaagcgcatctggcgcaactccagcgggcgctggcggcgggcgtgccgctgaagggctacttcgcctggagcctgctcgacaactttgagtgggcgatggggctgtcgatgcgctacggcatctgctacaccaacttcgagacgctggagcgccgcatcaaggacagtggctactggctgcgcgacttcatcgccggacagcgcggctga

SEQ ID NO: 4 - protein, 445 aa, Artificial Sequence
  Wild type beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 5 - DNA, 1335 bp, Artificial Sequence
  Wild type beta-glucosidase from Thermotoga
atgaaaaagtttcccgaagggttcctctggggagttgcgacagcttcctaccagatcgaaggctctccccttgcagacggagcaggtatgtccatctggcacaccttctcccatacacccggaaacgtgaaaaacggtgacactggagatgtggcctgcgatcactacaacagatggaaagaggacatcgagatcatcgaaaaaatcggtgcaaaggcctacagattctccatcagctggccaaggatccttccggaaggaacgggaaaagtgaaccagaaaggtctggacttctacaacaggatcatagacaccctcctggagaagaacataacaccatttataaccatctaccactgggaccttcccttttctctgcagttgaagggtggctgggcaaatcgggacatagccgactggttcgcagagtactcaagggttctctttgaaaacttcggtgaccgcgtcaaacactggatcactttgaacgaaccctgggtcgtcgctatagtgggacatctgtacggagtccatgcccctgggatgaaagacatctacgtagcattccatacggttcacaacctcttgagagcgcacgcaaaatccgtgaaggtgttcagagaaacggtgaaagacggaaagatagggattgttttcaacaacggatacttcgaacctgcaagtgagagagaagaagatatcagagccgccagattcatgcatcagttcaacaactacccgctctttttgaaccccatctacaggggagaatacccggatcttgtcctggaatttgcaagagagtacctccccagaaactatgaggatgacatggaagagataaaacaggagatcgacttcgttgggctgaactactattcaggtcacatggtgaaatacgatccgaactcaccggccagggtgtccttcgtcgaaagaaaccttcccaaaaccgccatgggatgggagatcgttcctgagggtatctactggattctcaaaggtgtcaaagaagagtacaacccacaggaggtgtacatcacagagaacggagctgcattcgacgacgtggtaagtgagggcggaaaagttcacgaccagaacaggatagattacttgagagcccacatcgaacaggtctggagagcaatccaggatggagtcccactgaagggttacttcgtgtggtcactccttgataacttcgagtgggcggaaggatattcgaagaggttcggtatagtgtacgtggactacaacacacagaagaggatcataaaagacagtggatactggtactcgaacgggatcaaaaacaacggactaacagattga

SEQ ID NO: 6 - protein, 444 aa, Artificial Sequence
  Wild type beta-glucosidase from Thermotoga
MKKFPEGFLWGVATASYQIEGSPLADGAGMSIWHTFSHTPGNVKNGDTGDVACDHYNRWKEDIEIIEKIGAKAYRFSISWPRILPEGTGKVNQKGLDFYNRIIDTLLEKNITPFITIYHWDLPFSLQLKGGWANRDIADWFAEYSRVLFENFGDRVKHWITLNEPWVVAIVGHLYGVHAPGMKDIYVAFHTVHNLLRAHAKSVKVFRETVKDGKIGIVFNNGYFEPASEREEDIRAARFMHQFNNYPLFLNPIYRGEYPDLVLEFAREYLPRNYEDDMEEIKQEIDFVGLNYYSGHMVKYDPNSPARVSFVERNLPKTAMGWEIVPEGIYWILKGVKEEYNPQEVYITENGAAFDDVVSEGGKVHDQNRIDYLRAHIEQVWRAIQDGVPLKGYFVWSLLDNFEWAEGYSKRFGIVYVDYNTQKRIIKDSGYWYSNGIKNNGLTD

SEQ ID NO: 7 - DNA, 1377 bp, Artificial Sequence
  Wild type beta-glucosidase from Thermobaculum
atgtcgcagccaagaaccgacctcgctccaggcaggtttcctgcagacttcacatgggggacggccaccgcggcctaccagatagagggcgcggtgcgcgaggatggccggggggtgtccatctgggaccgcttcagccacaccccgggcaagacccacaacggcgacaccggcgacgtggcctgcgaccactaccaccgctggcagggcgatatcgagctgatgcgtcgcctgcacgtcaacgcctacaggttctcgatcgcctggccccgcatcctgcccgaggggtggggcagggtcaacccgccggggctggacttctacgatcgcctggtggatggcctgctggccgcaggcatcaccccatgggtgacgctgtaccactgggacctgccccaggcactggaggatcgaggtggctggcccaaccccgatacctccaaggcgttcgccgagtacgccgacgtggtcacccggcggctgggcgacagggtcaagcactggatcaccctcaacgagccctgggtggtggccttcctgggctacttcaccggcgagcacgcccccggccggaaggagcccgagtcctacctgccggtggtgcacaacctgctgctggcccacggcctcgccgtgccggtcatcagggagaactcccgcgactcccaggtggggatcaccctgaacctgacccacgcctatccggccggcgacagcgccgaggacgaggccgcggccaagcggctggatggcttcatgaacaggtggttcctcgacccgctgttcacggggggctacccccgcgacatgatcgatgtcttcgggtcctgggtgccctccttcgacgagtcggaccttggggtgataggggcgcccctggacttcctgggggtgaactactacagcccctcgttcgtgcagcattcggagggcaacccgccgctgcatgtcgagcaggtgcgggtggacggagagtacaccgacatgggctggctggtgtatccccaggggctgtacgacctgctcacccggctgcacagggactactcccccgcggccatagtgatcactgagaacggtgcggcctatccggacgagccgccggtcgaggggcgggtgcacgatcccaagcgcgtggagtactacgcctcgcatctagacgccgcccagcgcgccatccgcgatggagtgcccctacgtgggtacttcgcctggtccctcatggacaacttcgagtgggccttcggctacagcaagcgtttcgggctgtactacgtggactacgagacgctggagcgcaccatcaaggacagcggcctgtggtacagccgcgtggtggccgagggccagctcgtgcccaccgagagcgttgcctga

SEQ ID NO: 8 - protein, 458 aa, Artificial Sequence
  Wild type beta-glucosidase from Thermobaculum
MSQPRTDLAPGRFPADFTWGTATAAYQIEGAVREDGRGVSIWDRFSHTPGKTHNGDTGDVACDHYHRWQGDIELMRRLHVNAYRFSIAWPRILPEGWGRVNPPGLDFYDRLVDGLLAAGITPWVTLYHWDLPQALEDRGGWPNPDTSKAFAEYADVVTRRLGDRVKHWITLNEPWVVAFLGYFTGEHAPGRKEPESYLPVVHNLLLAHGLAVPVIRENSRDSQVGITLNLTHAYPAGDSAEDEAAAKRLDGFMNRWFLDPLFTGGYPRDMIDVFGSWVPSFDESDLGVIGAPLDFLGVNYYSPSFVQHSEGNPPLHVEQVRVDGEYTDMGWLVYPQGLYDLLTRLHRDYSPAAIVITENGAAYPDEPPVEGRVHDPKRVEYYASHLDAAQRAIRDGVPLRGYFAWSLMDNFEWAFGYSKRFGLYYVDYETLERTIKDSGLWYSRVVAEGQLVPTESVA

SEQ ID NO: 9 - DNA, 1347 bp, Artificial Sequence
  Wild type beta-glucosidase from Clostridium
atgtcaaagataactttcccaaaagatttcatatggggttctgcaacagcagcatatcagattgaaggtgcatacaacgaagacggcaaaggtgaatctatatgggaccgtttttcccacacgccaggaaatatagcagacggacataccggcgatgttgcatgcgaccactatcatcgttatgaagaagatatcaaaataatgaaagaaatcggtattaaatcatacaggttttccatctcatggcccagaatctttcctgaaggaacaggtaaattaaatcaaaagggactggatttttacaaaaggctcacaaatctgcttctggaaaacggaattatgcctgcaatcactctttatcactgggaccttccccaaaagcttcaggataaaggcggatggaaaaaccgggacaccaccgattattttacagaatactctgaagtaatatttaaaaatctcggagatatcgttccaatatggtttactcacaatgaacccggtgttgtttctttgcttggccactttttaggaattcatgcccctgggataaaagacctccgcacttcattggaagtctcgcacaatcttcttttgtcccacggcaaggccgtgaaactgtttagagaaatgaatattgacgcccaaattggaatagctctcaatttatcttaccattatcccgcatccgaaaaagctgaggatattgaagcagcggaattgtcattttctctggcgggaaggtggtatctggatcctgtgctaaaaggccggtatcctgaaaacgcattgaaactttataaaaagaagggtattgagctttctttccctgaagatgacctgaaacttatcagtcagccaatagacttcatagcattcaacaattattcttcggaatttataaaatatgatccgtccagtgagtcaggtttttcacctgcaaactccatattagaaaagttcgaaaaaacagatatgggctggatcatatatcctgaaggcttgtatgatctgcttatgctccttgacagggattatggaaagccaaacattgttatcagcgaaaacggagccgccttcaaagatgaaataggtagcaacggaaagatagaagacacaaagagaatccaatatcttaaagattatctgacccaggctcacagggcaattcaggacggtgtaaacttaaaagcatactacttgtggtcgcttttggacaactttgaatgggcttacgggtacaacaagagattcggaatcgttcacgtaaattttgatacgttggaaagaaaaataaaggatagcggctactggtacaaagaagtaatcaaaaacaacggtttttaa

SEQ ID NO: 10 - protein, 448 aa, Artificial Sequence
  Wild type beta-glucosidase from Clostridium
MSKITFPKDFIWGSATAAYQIEGAYNEDGKGESIWDRFSHTPGNIADGHTGDVACDHYHRYEEDIKIMKEIGIKSYRFSISWPRIFPEGTGKLNQKGLDFYKRLTNLLLENGIMPAITLYHWDLPQKLQDKGGWKNRDTTDYFTEYSEVIFKNLGDIVPIWFTHNEPGVVSLLGHFLGIHAPGIKDLRTSLEVSHNLLLSHGKAVKLFREMNIDAQIGIALNLSYHYPASEKAEDIEAAELSFSLAGRWYLDPVLKGRYPENALKLYKKKGIELSFPEDDLKLISQPIDFIAFNNYSSEFIKYDPSSESGFSPANSILEKFEKTDMGWIIYPEGLYDLLMLLDRDYGKPNIVISENGAAFKDEIGSNGKIEDTKRIQYLKDYLTQAHRAIQDGVNLKAYYLWSLLDNFEWAYGYNKRFGIVHVNFDTLERKIKDSGYWYKEVIKNNGF

SEQ ID NO: 11 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 12 - protein, 741 aa, Artificial Sequence; identical to SEQ ID NO: 2
  Variant of beta-glucosidase from Bacteroides

SEQ ID NO: 13 - DNA, 1338 bp, Artificial Sequence
  Variant of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 14 - protein, 445 aa, Artificial Sequence; identical to SEQ ID NO: 4
  Variant of beta-glucosidase from uncultured td2f2

SEQ ID NO: 15 - DNA, 1341 bp, Artificial Sequence
  Variant of beta-glucosidase from Thermotoga
atgatcgtgaagaaattcccggaaggttttctgtggggcgttgcgaccgcgagctatcaaattgaaggtagcccgctggcggacggtgcgggtatgagcatctggcacaccttcagccacaccccgggtaacgtgaagaacggtgacaccggcgatgttgcgtgcgaccactacaaccgttggaaagaggatatcgaaatcattgagaagattggcgcgaaagcgtatcgtttcagcatcagctggccgcgtattctgccggaaggtaccggcaaggtgaaccagaaaggtctggacttttacaaccgtatcattgataccctgctggagaagaacattaccccgttcatcaccatttatcactgggatctgccgtttagcctgcaactgaaaggtggctgggcgaaccgtgacatcgcggattggttcgcggaatacagccgtgtgctgttcgagaactttggcgaccgtgttaagcactggattaccctgaacgaaccgtgggtggttgcgatcgttggtcacctgtatggtgttcatgcgccgggtatgaaagatatctatgtggcgttccacaccgttcacaacctgctgcgtgcgcacgcgaagagcgtgaaagtttttcgtgagaccgtgaaggacggtaaaatcggcattgttttcaacaacggctactttgaaccggcgagcgagcgtgaggaagatattcgtgcggcgcgtttcatgcaccagtttaacaactatccgctgttcctgaacccgatctaccgtggtgaatatccggacctggtgctggaatttgcgcgtgagtacctgccgcgtaactatgaagacgatatggaggaaatcaagcaagagattgacttcgtgggtctgaactactatagcggccacatggttaaatacgatccgaacagcccggcgcgtgtgagctttgttgagcgtaacctgccgaagaccgcgatgggttgggaaattgttccggagggcatctattggattctgaagggtgtgaaagaggaatacaacccgcaggaagtttatatcaccgagaacggtgcggcgttcgacgatgtggttagcgaaggtggcaaagtgcacgaccaaaaccgtatcgattacctgcgtgcgcacattgagcaggtttggcgtgcgatccaagacggtgtgccgctgaagggctacttcgtttggagcctgctggataactttgaatgggcggagggttatagcaaacgttttggcattgtgtacgttgactataacacccaaaagcgtatcattaaagatagcggctactggtatagcaacgttatcaagaacaacggtctgaccgactaa

SEQ ID NO: 16 - protein, 446 aa, Artificial Sequence
  Variant of beta-glucosidase from Thermotoga
MIVKKFPEGFLWGVATASYQIEGSPLADGAGMSIWHTFSHTPGNVKNGDTGDVACDHYNRWKEDIEIIEKIGAKAYRFSISWPRILPEGTGKVNQKGLDFYNRIIDTLLEKNITPFITIYHWDLPFSLQLKGGWANRDIADWFAEYSRVLFENFGDRVKHWITLNEPWVVAIVGHLYGVHAPGMKDIYVAFHTVHNLLRAHAKSVKVFRETVKDGKIGIVFNNGYFEPASEREEDIRAARFMHQFNNYPLFLNPIYRGEYPDLVLEFAREYLPRNYEDDMEEIKQEIDFVGLNYYSGHMVKYDPNSPARVSFVERNLPKTAMGWEIVPEGIYWILKGVKEEYNPQEVYITENGAAFDDVVSEGGKVHDQNRIDYLRAHIEQVWRAIQDGVPLKGYFVWSLLDNFEWAEGYSKRFGIVYVDYNTQKRIIKDSGYWYSNVIKNNGLTD

SEQ ID NO: 17 - DNA, 1377 bp, Artificial Sequence
  Variant of beta-glucosidase from Thermobaculum
atgtctcagccgcgtaccgatttagcaccgggtcgcttcccagccgatttcacatggggcaccgccaccgcagcctatcaaatcgaaggtgccgtacgcgaagacggtcgcggcgtctctatctgggaccgtttttcgcatacgccgggtaaaacccataacggcgataccggcgatgtggcatgtgaccattatcatcgttggcagggtgatattgaactgatgcgtcgcctccatgtgaatgcctatcgttttagcattgcgtggccacgcatccttccggaaggttgggggcgcgttaacccgccgggtctggacttctacgatcgcttggtggatggtctgctggccgcgggcattaccccgtgggtcacactgtaccattgggatctgccgcaggcactggaagaccgcggtggttggcccaacccggacacttcgaaagcgttcgccgagtacgccgatgtcgtcacgcgccgtttaggtgaccgtgttaaacattggatcacacttaacgaaccgtgggtggtagcgttcctgggctatttcacaggcgaacatgctccgggtcgtaaagaacctgagagctatctgcccgtagttcataacctgctgctggctcatggcttagcggtgccagtgatccgcgaaaatagccgtgattcgcaggtgggcattactctgaacctgacccatgcctatccagcgggcgattctgcggaagacgaagcagccgctaaacgcttagacggctttatgaaccgttggttcctggacccactgttcaccggtggctacccgcgtgatatgattgatgtgttcggttcatgggttccatctttcgacgaaagcgacctgggcgtcattggcgcgccgctggatttcctgggggtgaactattattcgccctcgttcgttcagcattcagaaggcaatccgccactgcacgtagaacaggtccgtgttgacggtgaatataccgacatgggttggttagtctatccacagggcctgtacgatctgctgacccgtctgcaccgtgattattcaccggcggcgatcgttattactgagaacggtgcagcctatccggacgaaccgccggtggaaggtcgtgttcacgatccgaaacgtgttgaatattatgcctcacatctggatgcagcacagcgtgcaatccgtgatggcgttccactgcgcggctattttgcgtggtctttaatggacaactttgagtgggcattcgggtatagcaaacgcttcggcctgtattatgtggattatgaaacactggaacgtaccatcaaagatagcggcctgtggtactctcgtgttgtcgcggaaggtcagctggttccgacggaaagtgtggcataa

SEQ ID NO: 18 - protein, 458 aa, Artificial Sequence; identical to SEQ ID NO: 8
  Variant of beta-glucosidase from Thermobaculum

SEQ ID NO: 19 - DNA, 1347 bp, Artificial Sequence
  Variant of beta-glucosidase from Clostridium
atgagcaagattacatttccgaaagattttatctggggctcagcgacggcagcctatcaaattgaaggtgcctataacgaagatggcaaaggtgaaagtatctgggaccgttttagccataccccaggcaatattgcagatggtcataccggcgatgtagcatgtgaccattatcatcgctacgaagaagatattaaaatcatgaaagaaattggtattaaaagctaccgttttagcatttcatggccgcgtattttcccagaaggcaccggtaagctgaaccaaaaaggcctggatttttacaaacgcttaactaatctgctgctggagaatggcattatgccagccattaccctgtaccattgggacctgccgcagaagttacaggacaaaggtggttggaaaaatcgtgataccacggattattttacggaatacagtgaagtaatctttaaaaatctgggagatattgttccgatctggtttacgcacaatgaaccgggtgtcgtgagtctgctgggtcatttcctgggcattcatgcgccgggcatcaaagatcttcgcacaagcctggaggtgagccacaacctgctgctctcgcacggcaaggctgtgaaactgtttcgtgagatgaatattgacgctcagattggcattgcgttgaatctgagctatcattacccggcaagcgaaaaggcggaagatattgaggcagccgaattgagctttagcctggccggtcgttggtatctggaccctgtgctgaaaggtcgctatccggagaatgcgctcaagctgtacaaaaaaaaaggcattgaactgagcttcccagaagacgaccttaaactgatctcgcagccaattgatttcatcgcgtttaacaattatagcagcgaatttattaaatacgatccgagcagcgaaagcggttttagcccggcgaatagtattctggaaaagttcgaaaaaaccgatatgggttggattatctatccagaaggtctgtatgatctgttaatgctgctggatcgcgattatggcaagcctaacattgtgatttcagaaaatggtgcagcgtttaaagacgagatcggttcaaatggcaagattgaagacacgaagcgcattcagtacctgaaagactacctgacccaggcccatcgtgcaattcaggatggtgtcaatcttaaagcgtattatctgtggagtctgctggataacttcgaatgggcgtatggctataacaaacgtttcggcatcgttcatgttaattttgatacactggaacgtaaaatcaaggatagcggctattggtacaaagaagtaatcaaaaacaacggcttctaa

SEQ ID NO: 20 - protein, 448 aa, Artificial Sequence; identical to SEQ ID NO: 10
  Variant of beta-glucosidase from Clostridium

SEQ ID NO: 21 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaatggcagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 22 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREWQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 23 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaagggatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 24 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVEGIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 25 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatctggaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 26 - protein, 741 aa, Artificial Sequence
  Variant of beta-glucosidase from Bacteroides
MQKAPRDMDRFIDQLMKKMTLEEKIGQLNLPVTGEIWTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 27 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactgagggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 28 - protein, 741 aa, Artificial Sequence
  Variant of beta-glucosidase from Bacteroides
MQKAPRDMDRFIDQLMKKMTLEEKIGQLNLPVTGEITEGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 29 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggctgctgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 30 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMAAVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 31 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctctgaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 32 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASLNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 33 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatggggggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 34 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMGGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 35 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaaccgtaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 36 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNRKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 37 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgtgtgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 38 - protein, 741 aa, Artificial Sequence
  Variant of beta-glucosidase from Bacteroides
MQKAPRDMDRFIDQLMKKMTLEEKIGQLNLCVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 39 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgggtgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 40 - protein, 741 aa, Artificial Sequence
  Variant of beta-glucosidase from Bacteroides
MQKAPRDMDRFIDQLMKKMTLEEKIGQLNLGVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 41 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccggtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaactgactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 42 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEAGADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 43 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcaagaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 44 - protein, 741 aa, Artificial Sequence
  Variant of beta-glucosidase from Bacteroides
MQKAPRDMDRFIDQLMKKMTLEEKIGQLNLPVTGEIKTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 45 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagacagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatgcctagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 46 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEDSADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMPSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 47 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgcggaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 48 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLRNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 49 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaagactgttcaacctgaaaggagtggaacgcatccgtgaagtacagcgtcaggcggtggaggagtctcgtttaggaattcctttgttgttcggtatggacgtaccgcacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 50 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGRLFNLKGVERIREVQRQAVEESRLGIPLLFGMDVPHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 51 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgccgggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacccggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 52 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLPGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTRSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 53 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagtgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggctagggtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 54 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMARVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 55 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctctggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 56 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSLGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 57 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacaggtagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 58 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTGSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 59 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaaggggttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 60 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKGFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 61 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagaatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 62 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKNFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 63 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggacggtaccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 64 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDGTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 65 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcgttctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 66 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFVLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 67 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatgaggagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 68 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMRSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 69 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctatggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 70 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSMGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 71 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtatttgcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 72 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVFASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 73 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtacatgcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 74 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVHASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 75 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaaggcgcgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 76 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKARSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 77 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatgcttgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 78 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMLVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 79 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtggagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 80 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVEHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 81 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagccgtgctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 82 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSRAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 83 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcaccgagagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 84 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTESVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 85 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttctgtctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 86 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFCLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 87 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtgggcgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacagtgtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 88 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVGVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDSVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 89 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatgagtgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcggttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 90 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMSVIHGYETIFPIPLGLSCTWDMKAIEESARIAAVEASADGISWTFSPMVDVSRDPRWGRVSEGNGEDPFLGAAIARAMIRGYQGKDMSRNDEIMACVKRFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 91 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctcatgggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 92 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSHGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 93 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctcctaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 94 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASPNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 95 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaaggagcgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 96 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKERSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 97 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttgcgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 98 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKLRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 99 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccattgagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 100 - protein, 741 aa, Artificial Sequence
  Variant of beta-glucosidase from Bacteroides
MQKAPRDMDRFIDQLMKKMTLEEKIGQLNLPVTIEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 101 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagccgactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 102 - protein, 741 aa, Artificial Sequence
  Variant of beta-glucosidase from Bacteroides
MQKAPRDMDRFIDQLMKKMTLEEKIGQLNLPVTGEPTTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 103 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtagggcacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagaggtacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 104 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVGHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEVRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 105 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttccgtctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 106 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFRLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 107 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgggaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 108 - protein, 741 aa, Artificial Sequence
  Variant of beta-glucosidase from Bacteroides
MQKAPRDMDRFIDQLMKKMTLEEKIGQLNLPGTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 109 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacccctagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 110 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTPSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 111 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggggtctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 112 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMGSFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 113 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgacccctgagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 114 - protein, 741 aa, Artificial Sequence
  Variant of beta-glucosidase from Bacteroides
MQKAPRDMDRFIDQLMKKMTLEEKIGQLNLPVTPEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 115 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaattgcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 116 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVIASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 117 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaaaatatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 118 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVENIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 119 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctagtaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 120 - protein, 741 aa, Artificial Sequence
  Variant of beta-glucosidase from Bacteroides
MQKAPRDMDRFIDQLMKKMTLEEKIGQLNLPSTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 121 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactttaccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 122 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDFTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 123 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgtcgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatcgtgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 124 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASVDGISWTFSPMVDVSRDPRWGRVSEGNGEDPFLGAAIARAMIRGYQGKDMSRNDEIMACVKHRALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 125 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatgaggtctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 126 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMRSFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 127 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctccggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 128 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSPGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 129 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctacggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 130 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSTGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 131 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacacggagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 132 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTRSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 133 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctcagaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 134 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASQNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 135 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagtatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 136 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKYFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 137 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaatggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 138 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLNGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 139 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggaccgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 140 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGPFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 141 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacagggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 142 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDRVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 143 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacacggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 144 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDTVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 145 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccgggttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 146 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATGFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 147 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccccgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 148 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATPFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 149 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacttgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 150 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGLVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 151 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcccaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggtggccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 152 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGWPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 153 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctgtgaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaccgagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 154 - protein, 741 aa, Artificial Sequence
  Variant of beta-glucosidase from Bacteroides
MQKAPRDMDRFIDQLMKKMTLEEKIGQLNLPVTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGEPSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 155 - DNA, 2226 bp, Artificial Sequence
  Variant of beta-glucosidase from Bacteroides
atgcaaaaagctcctagagatatggatagatttatcgaccagttaatgaaaaagatgacgctggaggagaagatcggccagttaaacctgcctcctaccggagagatcactaccggacaggcgaaaagcagcgatgtagccaaacgaatccgtaacggagaggtgggaggactgttcaacctgaaaggagtggaacgcatccgtgaagtacagcgtcaggcggtggaggagtctcgtttaggaattcctttgttgttcggtatggacgtaatccacggatacgaaaccattttccctattcctttaggcctgtcttgtacctgggatatgaaagccatcgaagagtctgcccgtatagctgccgtcgaagccagtgccgacggtatctcttggacattcagcccgatggtggacgtcagccgtgacccgcgctggggacgtgtgtctgaggggaacggtgaagacccgttcttaggcgcagccatcgcccgtgccatgatacgcggataccagggaaaggatatgagccgtaatgacgagataatggcttgtgtgaagcatttcgccctttatggagcatcagaggcggggcgcgattataatacggtggatatgagccgccagcgtatgttcaatgaatacatgctgccttatcaggccgcagtcgaggcaggtgtcggcagcgtaatggcttctttcaatgaagtggatggtgtgcctgccaccggaagcaagtggctgatgaccgatgtgctgcgcaagcagtggggtttcgacgggtttgtggtaacggactataccggtatcaacgagatgatagaccacggcatgggtgaccagcagactgttgccgccttagccctgaatgccggggtggatatggacatggtgagcgatgccttcagcggcactctgaagaagtctgtggaggaaggcaaagtatctgcagctgccatcgacgccgcctgccgccgtattctggaagcgaagtataagctgggactgtttgacaatccttataaatattgcgacgtgaatcgtcctaagaagcagatcttcaccaaggaacaccgtgccattgcccgtaagactgcttctgagagctttgtgctgctgaagaatgaaggtgtgttgccattaagcaagaaaggaaccattgccgtagtcggtccgttggcgaacacccgttctaacatgccgggcacctggagcgtagctgctgtgctggataacgctccttctctggtcgaaggattacgtgaagtagtcggtgaccgtgcaaaagtggtaaccgccaagggaagcaatctgattggcgatgccgactatgagaagcgcgccaccatgttcggacgtgaactgcatcgtgataaccgtacggatcgcgaacttctggacgaagctctgaaagtggctgccggggccgatgtcattgtcgccgcactgggcgagtcttctgaaatgagtggagaaagcagttctcgtaccaacctggagatgccggatgtacagagagcgctgttgcaggaattattaaaaaccggaaagcctgttgtgcttgtgctttttaccggtcgcccgctggtgttaacctgggaagaagaacacgtgcctgccatcttaaacgtatggttcggagggagtgaagccgcttatgccatcagcgatgtgcttttcggcgatgtcaatcctagtggaaaactgaccgctacttttccgcaaaatgtaggccagattccattgttctacaatcataaaaacaccgggcgtccgttgcaagagggacgttggtttgagaagttccgcagcaattacttagacgtgagcaacgagccattatacccgtttggctacggattgtcttatacgacttttgcctacagtgatattcacctgagcagcacggagatgagtgctgatggcgaactgacggcgactgttaccgtcaccaataccggcagccgtgacggagcggaggtggttcagctttacatccgcgacctggtgggcagcgtcacccgtccggtgaaagaactgaaaggttttgagaagattttcttaaaggccggagagtctcgtaaagtaagcttcagcatcacgccggaattgttgaagttctataattacgatttgcagtttgtctgcgaaccgggtgatttcgatgtaatgattggcggaaacagccgtgatgtaaaaaaggcacgatttcttctgaagggagaatga

SEQ ID NO: 156 - protein, 741 aa, Artificial Sequence
  Variant of beta-glucosidase from Bacteroides
MQKAPRDMDRFIDQLMKKMTLEEKIGQLNLPPTGEITTGQAKSSDVAKRIRNGEVGGLFNLKGVERIREVQRQAVEESRLGIPLLFGMDVIHGYETIFPIPLGLSCTWDMKAIEESARIAAVEASADGISWTFSPMVDVSRDPRWGRVSEGNGEDPFLGAAIARAMIRGYQGKDMSRNDEIMACVKHFALYGASEAGRDYNTVDMSRQRMFNEYMLPYQAAVEAGVGSVMASFNEVDGVPATGSKWLMTDVLRKQWGFDGFVVTDYTGINEMIDHGMGDQQTVAALALNAGVDMDMVSDAFSGTLKKSVEEGKVSAAAIDAACRRILEAKYKLGLFDNPYKYCDVNRPKKQIFTKEHRAIARKTASESFVLLKNEGVLPLSKKGTIAVVGPLANTRSNMPGTWSVAAVLDNAPSLVEGLREVVGDRAKVVTAKGSNLIGDADYEKRATMFGRELHRDNRTDRELLDEALKVAAGADVIVAALGESSEMSGESSSRTNLEMPDVQRALLQELLKTGKPVVLVLFTGRPLVLTWEEEHVPAILNVWFGGSEAAYAISDVLFGDVNPSGKLTATFPQNVGQIPLFYNHKNTGRPLQEGRWFEKFRSNYLDVSNEPLYPFGYGLSYTTFAYSDIHLSSTEMSADGELTATVTVTNTGSRDGAEVVQLYIRDLVGSVTRPVKELKGFEKIFLKAGESRKVSFSITPELLKFYNYDLQFVCEPGDFDVMIGGNSRDVKKARFLLKGE

SEQ ID NO: 157 - DNA, 2226 bp, Artificial Sequence; identical to SEQ ID NO: 61
  Variants of beta-glucosidase from Bacteroides

SEQ ID NO: 158 - protein, 741 aa, Artificial Sequence; identical to SEQ ID NO: 62
  Variants of beta-glucosidase from Bacteroides

SEQ ID NO: 159 - DNA, 2226 bp, Artificial Sequence; identical to SEQ ID NO: 63
  Variants of beta-glucosidase from Bacteroides

SEQ ID NO: 160 - protein, 741 aa, Artificial Sequence; identical to SEQ ID NO: 64
  Variants of beta-glucosidase from Bacteroides

SEQ ID NO: 161 - DNA, 2226 bp, Artificial Sequence; identical to SEQ ID NO: 65
  Variants of beta-glucosidase from Bacteroides

SEQ ID NO: 162 - protein, 741 aa, Artificial Sequence; identical to SEQ ID NO: 66
  Variants of beta-glucosidase from Bacteroides

SEQ ID NO: 163 - DNA, 2226 bp, Artificial Sequence; identical to SEQ ID NO: 67
  Variants of beta-glucosidase from Bacteroides

SEQ ID NO: 164 - protein, 741 aa, Artificial Sequence; identical to SEQ ID NO: 68
  Variants of beta-glucosidase from Bacteroides

SEQ ID NO: 165 - DNA, 2226 bp, Artificial Sequence; identical to SEQ ID NO: 71
  Variants of beta-glucosidase from Bacteroides

SEQ ID NO: 166 - protein, 741 aa, Artificial Sequence; identical to SEQ ID NO: 72
  Variants of beta-glucosidase from Bacteroides

SEQ ID NO: 167 - DNA, 2226 bp, Artificial Sequence; identical to SEQ ID NO: 85
  Variants of beta-glucosidase from Bacteroides

SEQ ID NO: 168 - protein, 741 aa, Artificial Sequence; identical to SEQ ID NO: 86
  Variants of beta-glucosidase from Bacteroides

SEQ ID NO: 169 - DNA, 2226 bp, Artificial Sequence; identical to SEQ ID NO: 89
  Variants of beta-glucosidase from Bacteroides

SEQ ID NO: 170 - protein, 741 aa, Artificial Sequence; identical to SEQ ID NO: 90
  Variants of beta-glucosidase from Bacteroides

SEQ ID NO: 171 - DNA, 2226 bp, Artificial Sequence; identical to SEQ ID NO: 91
  Variants of beta-glucosidase from Bacteroides

SEQ ID NO: 172 - protein, 741 aa, Artificial Sequence; identical to SEQ ID NO: 92
  Variants of beta-glucosidase from Bacteroides

SEQ ID NO: 173 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgttgtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 174 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPLCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 175 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgggttgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 176 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPGCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 177 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgccatgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 178 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCHAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 179 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgcatccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 180 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLHPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 181 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaatccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 182 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLNPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 183 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggccatcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgacccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 184 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGHHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 185 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggccgtcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 186 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGRHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 187 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgggaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 188 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFGNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 189 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttattaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 190 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFINRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 191 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttcttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 192 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFLNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 193 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccggagtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 194 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPECSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 195 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgcagtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggtgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 196 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPQCSAMLGYYLGVHAPGHTDLKRGLEASHNLLLGHGLAVQAMRAAAPQPLQIGIVLNLTPTYPASDSPEDVAAARRFDGFVNRWFLDPLVGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 197 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtcttgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 198 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPSCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 199 - DNA, 1338 bp, Artificial Sequence
  Variants of beta-glucosidase from uncultured td2f2
atggcgggcgagcgttttccggcggattttgtttggggcgcgtctaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 200 - protein, 445 aa, Artificial Sequence
  Variants of beta-glucosidase from uncultured td2f2
MAGERFPADFVWGASTAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 201 - DNA, 1338 bp, Artificial Sequence
  Variants of beta-glucosidase from uncultured td2f2
atggcgggcgagcgttttccggcggattttgtttggggcgcggcgaccggggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 202 - protein, 445 aa, Artificial Sequence
  Variants of beta-glucosidase from uncultured td2f2
MAGERFPADFVWGAATGAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 203 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgggctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 204 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCGLHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 205 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgcctgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 206 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVAPDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 207 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaaccatgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 208 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNHEWAMGLSMRYGICYTNFETLERRIKDSGYWLRDFIAGQRG

SEQ ID NO: 209 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactgggaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 210 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNWEWAMGLSMRYGICYTNFETLERRIKDSGYWLRDFIAGQRG

SEQ ID NO: 211 - DNA, 1338 bp, Artificial Sequence
  Variants of beta-glucosidase from uncultured td2f2
atggcgggcgagcgttttccggcggattttgtttggggcgcggcgaccgcggcgtaccaggcggagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 212 - protein, 445 aa, Artificial Sequence
  Variants of beta-glucosidase from uncultured td2f2
MAGERFPADFVWGAATAAYQAEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 213 - DNA, 1338 bp, Artificial Sequence
  Variants of beta-glucosidase from uncultured td2f2
atggcgggcgagcgttttccggcggattttgtttggggcgcggcgaccgcggcgtaccaggaggagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 214 - protein, 445 aa, Artificial Sequence
  Variants of beta-glucosidase from uncultured td2f2
MAGERFPADFVWGAATAAYQEEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 215 - DNA, 1338 bp, Artificial Sequence
  Variants of beta-glucosidase from uncultured td2f2
atggcgggcgagcgttttccggcggattttgtttggggcgcggcgaccgcggcgtaccagtttgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 216 - protein, 445 aa, Artificial Sequence
  Variants of beta-glucosidase from uncultured td2f2
MAGERFPADFVWGAATAAYQFEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 217 - DNA, 1338 bp, Artificial Sequence
  Variants of beta-glucosidase from uncultured td2f2
atggcgggcgagcgttttccggcggattttgtttggggcgcggcgaccgcggcgtaccagggggagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 218 - protein, 445 aa, Artificial Sequence
  Variants of beta-glucosidase from uncultured td2f2
MAGERFPADFVWGAATAAYQGEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 219 - DNA, 1338 bp, Artificial Sequence
  Variants of beta-glucosidase from uncultured td2f2
atggcgggcgagcgttttccggcggattttgtttggggcgcggcgaccgcggcgtaccagcatgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 220 - protein, 445 aa, Artificial Sequence
  Variants of beta-glucosidase from uncultured td2f2
MAGERFPADFVWGAATAAYQHEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 221 - DNA, 1338 bp, Artificial Sequence
  Variants of beta-glucosidase from uncultured td2f2
atggcgggcgagcgttttccggcggattttgtttggggcgcggcgaccgcggcgtaccagtctgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 222 - protein, 445 aa, Artificial Sequence
  Variants of beta-glucosidase from uncultured td2f2
MAGERFPADFVWGAATAAYQSEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 223 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagctggcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 224 - protein, 445 aa, Artificial Sequence
  Variants of beta-glucosidase from uncultured td2f2
MAGERFPADFVWGAATAAYQIEGAVREDGRGVSIWDTFSHTPGKLADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 225 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgacctataacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 226 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATYNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 227 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgaaggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 228 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLKDNFEWAMGLSMRYGICYTNFETLERRIKDSGYWLRDFIAGQRG

SEQ ID NO: 229 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtgcgagcatgcgttacggcatctgctataccaacttcgagaccctggaacgtcgtatcaaagatagcggttattggctgcgtgactttattgcgggtcagcgtggctaa

SEQ ID NO: 230 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGASMRYGICYTNFETLERRIKDSGYWLRDFIAGQRG

SEQ ID NO: 231 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtgatagcatgcgttacggcatctgctataccaacttcgagaccctggaacgtcgtatcaaagatagcggttattggctgcgtgactttattgcgggtcagcgtggctaa

SEQ ID NO: 232 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGDSMRYGICYTNFETLERRIKDSGYWLRDFIAGQRG

SEQ ID NO: 233 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtgggagcatgcgttacggcatctgctataccaacttcgagaccctggaacgtcgtatcaaagatagcggttattggctgcgtgactttattgcgggtcagcgtggctaa

SEQ ID NO: 234 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGGSMRYGICYTNFETLERRIKDSGYWLRDFIAGQRG

SEQ ID NO: 235 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtaggagcatgcgttacggcatctgctataccaacttcgagaccctggaacgtcgtatcaaagatagcggttattggctgcgtgactttattgcgggtcagcgtggctaa

SEQ ID NO: 236 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGRSMRYGICYTNFETLERRIKDSGYWLRDFIAGQRG

SEQ ID NO: 237 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtacgagcatgcgttacggcatctgctataccaacttcgagaccctggaacgtcgtatcaaagatagcggttattggctgcgtgactttattgcgggtcagcgtggctaa

SEQ ID NO: 238 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGTSMRYGICYTNFETLERRIKDSGYWLRDFIAGQRG

SEQ ID NO: 239 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgacgggtctgagcatgcgttacggcatctgctataccaacttcgagaccctggaacgtcgtatcaaagatagcggttattggctgcgtgactttattgcgggtcagcgtggctaa

SEQ ID NO: 240 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWATGLSMRYGICYTNFETLERRIKDSGYWLRDFIAGQRG

SEQ ID NO: 241 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcgcgcgttacggcatctgctataccaacttcgagaccctggaacgtcgtatcaaagatagcggttattggctgcgtgactttattgcgggtcagcgtggctaa

SEQ ID NO: 242 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSARYGICYTNFETLERRIKDSGYWLRDFIAGQRG

SEQ ID NO: 243 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagccatcgttacggcatctgctataccaacttcgagaccctggaacgtcgtatcaaagatagcggttattggctgcgtgactttattgcgggtcagcgtggctaa

SEQ ID NO: 244 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSHRYGICYTNFETLERRIKDSGYWLRDFIAGQRG

SEQ ID NO: 245 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcccgcgttacggcatctgctataccaacttcgagaccctggaacgtcgtatcaaagatagcggttattggctgcgtgactttattgcgggtcagcgtggctaa

SEQ ID NO: 246 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSPRYGICYTNFETLERRIKDSGYWLRDFIAGQRG

SEQ ID NO: 247 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagtcgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcccgcgttacggcatctgctataccaacttcgagaccctggaacgtcgtatcaaagatagcggttattggctgcgtgactttattgcgggtcagcgtggctaa

SEQ ID NO: 248 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQSLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSPRYGICYTNFETLERRIKDSGYWLRDFIAGQRG

SEQ ID NO: 249 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaagtgctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 250 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQVLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 251 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatggattacggcatctgctataccaacttcgagaccctggaacgtcgtatcaaagatagcggttattggctgcgtgactttattgcgggtcagcgtggctaa

SEQ ID NO: 252 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMDYGICYTNFETLERRIKDSGYWLRDFIAGQRG

SEQ ID NO: 253 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgcttatgcgttacggcatctgctataccaacttcgagaccctggaacgtcgtatcaaagatagcggttattggctgcgtgactttattgcgggtcagcgtggctaa

SEQ ID NO: 254 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLLMRYGICYTNFETLERRIKDSGYWLRDFIAGQRG

SEQ ID NO: 255 - DNA, 1338 bp, Artificial Sequence
  Variants of beta-glucosidase from uncultured td2f2
atggcgggcgagcgttttccggcggattttgtttggggcgcggcggctgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 256 - protein, 445 aa, Artificial Sequence
  Variants of beta-glucosidase from uncultured td2f2
MAGERFPADFVWGAAAAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 257 - DNA, 1338 bp, Artificial Sequence
  Variants of beta-glucosidase from uncultured td2f2
atggcgggcgagcgttttccggcggattttgtttggggcgcggcgggtgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 258 - protein, 445 aa, Artificial Sequence
  Variants of beta-glucosidase from uncultured td2f2
MAGERFPADFVWGAAGAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 259 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattgcggagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 260 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYIAENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 261 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattcttgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 262 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYILENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 263 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcatttgtctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 264 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGICLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 265 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattggtctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 266 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIGLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 267 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccactggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattacgctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 268 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGITLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 269 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgaagtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 270 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPKCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 271 - DNA, 1338 bp, Artificial Sequence
  Variants of beta-glucosidase from uncultured td2f2
atggcgggcgagcgttttccggcggattttgtttggggcgcggcgaccgcggcggggcagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 272 - protein, 445 aa, Artificial Sequence
  Variants of beta-glucosidase from uncultured td2f2
MAGERFPADFVWGAATAAGQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 273 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcggggcgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 274 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAGRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 275 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgttgcgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 276 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNALRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 277 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtattcgtgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 278 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYSWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 279 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacccttttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 280 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDPFEWAMGLSMRYGICYTNFETLERRIKDSGYWLRDFIAGQRG

SEQ ID NO: 281 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggactcttttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 282 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDSFEWAMGLSMRYGICYTNFETLERRIKDSGYWLRDFIAGQRG

SEQ ID NO: 283 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttacgatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 284 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFTIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 285 - DNA, 1338 bp, Artificial Sequence
  Variants of beta-glucosidase from uncultured td2f2
atggcgggcgagcgttttccggcggattttgtttggggcgcggcgtcggcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcatattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 286 - protein, 445 aa, Artificial Sequence
  Variants of beta-glucosidase from uncultured td2f2
MAGERFPADFVWGAASAAYQIEGAVREDGRGVSIWDTFSHTPGKIADGTTGDVACDSYHRYGEDIGLLNALGMNAYRFSIAWPHIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 287 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgtatccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 288 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLYPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 289 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatctgggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattccgctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggtgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 290 - protein, 445 aa, Artificial Sequence
  Variants of beta-glucosidase from uncultured td2f2
MAGERFPADFVWGAATAAYQIEGAVREDGRGVSIWDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIPLNLTPTYPASDSPEDVAAARRFDGFVNRWFLDPLAGRGYPQDMLDYYGAAAPQANPEDLTQIAAPLDWLGVNYYERMRAVDAPDASLPQVQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 291 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatcgctgacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 292 - protein, 445 aa, Artificial Sequence
  Variants of beta-glucosidase from uncultured td2f2
MAGERFPADFVWGAATAAYQIEGAVREDGRGVSIADTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

SEQ ID NO: 293 - DNA, 1338 bp, Artificial Sequence
  Variants of beta-glucosidase from uncultured td2f2
atggcgggcgagcgttttccggcggattttgtttggggcgcggcgaccgcggcgtaccagattgagggtgcggtgcgtgaagatggtcgtggcgttagcatcggggacaccttcagccacaccccgggcaagattgcggatggtaccaccggtgatgtggcgtgcgatagctaccaccgttatggtgaagacatcggcctgctgaacgcgctgggcatgaacgcgtaccgttttagcatcgcgtggccgcgtattgttccgctgggtgcgggtccgattaaccaagcgggtctggatcactacagccgtatggttgatgcgctgctgggtgcgggtctgcagccgttcgttaccctgtatcactgggatctgccgcaaccgctggaggatcgtctgggttggggcagccgtgcgaccgcgaccgtgtttgcggaatacgcggatattgtggttcgtcagctgggtgaccgtgttacccactgggcgaccctgaacgagccgtggtgcagcgcgatgctgggttactatctgggcgttcatgcgccgggtcacaccgacctgaaacgtggcctggaagcgagccacaacctgctgctgggtcatggtctggcggtgcaagcgatgcgtgcggcggcgccgcagccgctgcaaatcggcattgttctgaacctgaccccgacctatccggcgagcgacagcccggaggatgtggcggcggcgcgtcgtttcgatggttttgttaaccgttggtttctggacccgctggcgggtcgtggctatccgcaggacatgctggattactatggtgcggcggcgccgcaggcgaacccggaggatctgacccagattgcggcgccgctggactggctgggtgtgaactactatgagcgtatgcgtgcggttgatgcgccggatgcgagcctgccgcaggcgcaacgtctggatgatccggatctgccgcacaccgcggaccgtgaggtgtacccggaaggtctgtatgatatcctgctgcgtctgcacaacgactacccgtttcgtccgctgtatattaccgagaacggttgcgcgctgcatgatgagattgcggaagatggtggcattcacgacggtcagcgtcaagcgttctttgaagcgcacctggcgcagctgcaacgtgcgctggcggcgggtgttccgctgaagggttacttcgcgtggagcctgctggacaactttgaatgggcgatgggtctgagcatgcgttacggcatctgctataccaacttcgagaccctggaacgtcgtatcaaagatagcggttattggctgcgtgactttattgcgggtcagcgtggctaa

SEQ ID NO: 294 - protein, 445 aa, Artificial Sequence
  Variants of beta-glucosidase from uncultured td2f2
MAGERFPADFVWGAATAAYQIEGAVREDGRGVSIGDTFSHTPGKIADGTTGDVACDSYHRYGEDIGLLNALGMNAYRFSIAWPRIVPLGAGPINQAGLDHYSRMVDALLGAGLQPFVTLYHWDLPQPLEDRLGWGSRATATVFAEYADIVVRQLGDRVTHWATLNEPWCSAMLGYYLGVHAPGHTDLKRGLEASHNLLLGHGLAVQAMRAAAPQPLQIGIVLNLTPTYPASDSPEDVAAARRFDGFVNRWFLDPLAGRGYPQDMLDYYGAAAPQANPEDLTQIAAPLDWLGVNYYERMRAVDAPDASLPQAQRLDDPDLPHTADREVYPEGLYDILLRLHNDYPFRPLYITENGCALHDEIAEDGGIHDGQRQAFFEAHLAQLQRALAAGVPLKGYFAWSLLDNFEWAMGLSMRYGICYTNFETLERRIKDSGYWLRDFIAGQRG

We claim:

1. A non-naturally occurring beta-glucosidase variant having at least 80% sequence identity to SEQ ID NO: 14, wherein said variant comprises at least one substitution or substitution set at one or more positions 15, 16, 16/84, 17, 19, 21, 35, 45, 55, 76, 79, 121, 164, 168, 168/256, 170, 179, 215/413, 221, 221/311, 225, 247, 313, 351, 356, 402, 404, 405, 409, 411, 412, 413, and 414, wherein said positions are numbered with reference to SEQ ID NO:14.

2. The non-naturally occurring beta-glucosidase variant of claim 1, wherein said variant comprises at least one substitution or substitution set 15S, 16A/G, 16S/84H, 17G, 19G, 21A/E/F/G/H/S, 35A/G, 45L, 55P, 76G/L, 76L, 79T, 121S, 164Y, 168E/G/K/L/S, 168Q/256V, 170H, 179H/R, 215S/413P, 221C/G/T, 221P/311V, 225H/N/Y, 247G/I/L, 313V, 351A/L, 356G, 402K, 404P/S, 405H/W, 409T, 411A/D/G/R/T, 412L, 413A/H/P, or 414D, wherein said positions are numbered with reference to SEQ ID NO:14.

3. The non-naturally occurring beta-glucosidase variant of claim 1, wherein said variant comprises at least one substitution or substitution set A15S, T16A/G, T16S/R84H, A17G, Y19G, I21A/E/F/G/H/S, W35A/G, I45L, C55P, Y76G/L, S79T, H121S, L164Y, W168E/G/K/L/S, W168Q/A256V, S170H, V179H/R, P215S/M413P, V221C/G/T, V221P/A311V, T225H/N/Y, V247G/I/L, R313V, T351A/L, A356G, L402K, N404P/S, F405H/W, M409T, L411A/D/G/R/T, S412L, M413A/H, M413P, or R414D relative to SEQ ID NO:14, wherein said positions are numbered with reference to SEQ ID NO:14.

4. The non-naturally occurring beta-glucosidase variant of claim 1, wherein said variant comprises the polypeptide sequence of SEQ ID NO: 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, or 294.

5. A recombinant polynucleotide encoding at least one non-naturally occurring beta-glucosidase variant provided in claim 1.

6. The recombinant polynucleotide of claim 5, wherein said polynucleotide comprises the sequence of SED ID NO: 173, 175, 177, 179, 181, 183, 185, 187, 189, 191,193,195, 197,199,201,203,205,207,209,211,213,215,217,219,221, 223,225,227,229,231, 233,235,237,239,241,243,245,247, 249,251,253,255,257,259,261,263,265,267,269,271,273, 275, 277, 279, 281, 283, 285, 287, 289, 291, or 293.

7. The recombinant polynucleotide of claim 5, wherein said polynucleotide encodes a polypeptide comprising the polypeptide sequence of SEQ ID NO: 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, or 294.

8. A vector comprising at least one recombinant polynucleotide as set forth in claim 5.

9. The vector of claim 8, wherein said vector further comprises at least one control sequence.

10. A host cell comprising the vector provided in claim 8.

11. The host cell of claim 10, wherein said host cell is selected from eukaryotic and prokaryotic organisms.

12. The host cell of claim 10, wherein said host cell is *E. coli*.

13. A method for producing at least one non-naturally occurring beta-glucosidase variant, comprising culturing the host cell of claim 10 under conditions such that said non-naturally occurring beta-glucosidase variant is produced by said host cell.

14. The method of claim 13, further comprising the step of recovering said non-naturally occurring beta-glucosidase variant.

15. A composition comprising at least one non-naturally occurring beta-glucosidase variant of claim 1.

16. A method for converting a glycosyl group acceptor substrate to a beta-glucosylated product, comprising: providing at least one glycosyl group acceptor substrate, at least one glycosyl group donor co-substrate, and at least one beta-glucosidase of claim 1; contacting said glycosyl group acceptor substrate, glycosyl group donor co-substrate, and beta-glucosidase under conditions such that said substrate is glucosylated by said beta-glucosidase to provide a beta-glucosylated product.

17. The method of claim 16, wherein said glycosyl group donor co-substrate is selected from disaccharides, trisaccharides, oligosaccharides, cellobiose, gentiobiose, laminaribiose, and cellulose.

18. The method of claim 16, wherein said glycosyl group acceptor substrate is glycosylated.

19. The method of claim 18, wherein said glycosyl group acceptor substrate is a naturally-occurring glycosylated substrate.

20. The method of claim 19, wherein said naturally-occurring glycosylated glycosyl group acceptor substrate is selected from stevioside, rebaudioside A, or rebaudioside D.

21. The method of claim 18, wherein said glycosyl group acceptor substrate is a non-naturally occurring glycosylated substrate.

22. The method of claim 16, wherein said glycosyl group acceptor substrate is an aglycosylated natural substance.

23. The method of claim 16, wherein said glycosyl group acceptor substrate is a non-naturally occurring aglycosylated substance.

24. The method of claim 16, wherein the beta-glucosidase comprises the polypeptide sequence of SEQ ID NO: 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, or 294.

25. The non-naturally occurring beta-glucosidase variant of claim 1, wherein the beta-glucosidase variant has at least 90%, sequence identity to SEQ ID NO: 14.

26. The non-naturally occurring beta-glucosidase variant of claim 1, wherein the beta-glucosidase variant has at least 95%, sequence identity to SEQ ID NO: 14.

27. The non-naturally occurring beta-glucosidase variant of claim 1, wherein the beta-glucosidase variant has at least 98% sequence identity to SEQ ID NO: 14.

28. The non-naturally occurring beta-glucosidase variant of claim 1, wherein the beta-glucosidase variant has at least 99% sequence identity to SEQ ID NO: 14.

29. The non-naturally occurring beta-glucosidase variant of claim 1, wherein said variant comprises at least one substitution or substitution set at one or more positions 16, 16/84, 17, 21, 79, 168, 168/256, 221, 221/311, 225, 247, 356, 404, 405, and 411, wherein said positions are numbered with reference to SEQ ID NO:14.

30. The non-naturally occurring beta-glucosidase variant of claim 1, wherein said variant comprises at least one substitution at one or more positions 17, 21, 221, and 247, wherein said positions are numbered with reference to SEQ ID NO:14.

31. The non-naturally occurring beta-glucosidase variant of claim 29, wherein said variant comprises at least one substitution or substitution set 16A/G, 16S/84H, 17G, 21A/E/F/G/H/S, 79T, 168E/G/K/L/S, 168Q/256V, 221C/G/T, 221P/311V, 225H/N/Y, 247G/I/L, 356G, 404P/S, 405H/W, or 411A/D/G/R/T, wherein said positions are numbered with reference to SEQ ID NO:14.

32. The non-naturally occurring beta-glucosidase variant of claim 30, wherein said variant comprises at least one substitution or substitution set 17G, 21A/E/F/G/H/S, 79T, 221C/G/T, or 247G/I/L, 356G, 404P/S, 405H/W, and 411A/D/G/R/T, wherein said positions are numbered with reference to SEQ ID NO:14.

* * * * *